US009624530B2

(12) United States Patent
Lewin

(10) Patent No.: US 9,624,530 B2
(45) Date of Patent: Apr. 18, 2017

(54) METHODS FOR PRESERVATION OF GENOMIC DNA SEQUENCE COMPLEXITY

(75) Inventor: Joern Lewin, Berlin (DE)

(73) Assignee: EPIGENOMICS AG, Berlin (DE)

(*) Notice: Subject to any disclaimer, the term of this patent is extended or adjusted under 35 U.S.C. 154(b) by 183 days.

(21) Appl. No.: 12/848,239

(22) Filed: Aug. 2, 2010

(65) Prior Publication Data

US 2011/0027789 A1    Feb. 3, 2011

(30) Foreign Application Priority Data

Aug. 3, 2009  (EP) .................................... 09167075

(51) Int. Cl.
| | |
|---|---|
| C12Q 1/68 | (2006.01) |
| C12Q 1/48 | (2006.01) |
| C12N 9/00 | (2006.01) |
| C07H 21/02 | (2006.01) |
| C07H 21/04 | (2006.01) |

(52) U.S. Cl.
CPC ......... *C12Q 1/6806* (2013.01); *C12Q 1/6858* (2013.01); *C12Q 1/6886* (2013.01); *C12Q 2600/154* (2013.01)

(58) Field of Classification Search
CPC ... C12Q 1/68; C12Q 1/48; C12N 9/00; C12N 9/10; C07H 21/04
USPC ........ 435/6.1, 6.11, 14, 91.2, 183; 536/23.1, 536/24.3
See application file for complete search history.

(56) References Cited

U.S. PATENT DOCUMENTS

| | | | |
|---|---|---|---|
| 5,514,758 | A | 5/1996 | Muller et al. |
| 5,565,552 | A | 10/1996 | Magda et al. |
| 5,567,810 | A | 10/1996 | Weis et al. |
| 5,574,142 | A | 11/1996 | Meyer, Jr. et al. |
| 5,585,481 | A | 12/1996 | Arnold, Jr. et al. |
| 5,587,371 | A | 12/1996 | Sessler et al. |
| 5,597,696 | A | 1/1997 | Linn et al. |
| 5,786,146 | A | 7/1998 | Herman et al. |
| 5,958,773 | A | 9/1999 | Monia et al. |
| 6,251,594 | B1 | 6/2001 | Gonzalgo et al. |
| 6,265,171 | B1 | 7/2001 | Herman et al. |
| 2002/0197639 | A1* | 12/2002 | Shia et al. ......... 435/6 |
| 2003/0013091 | A1 | 1/2003 | Dimitrov |
| 2005/0196792 | A1 | 9/2005 | Fodor et al. |
| 2006/0286576 | A1* | 12/2006 | Lofton-Day et al. ......... 435/6 |
| 2010/0081174 | A1* | 4/2010 | Dunn ..................... 435/91.2 |

FOREIGN PATENT DOCUMENTS

| | | |
|---|---|---|
| DE | WO0231186 * | 4/2002 |
| DE | 10331107 | 12/2004 |
| EP | 1 568 786 A2 | 8/2005 |
| WO | WO 99/10540 A1 | 3/1999 |
| WO | WO 00/26401 | 5/2000 |
| WO | WO 00/70090 | 11/2000 |
| WO | WO 01/62064 | 8/2001 |
| WO | WO 01/62960 | 8/2001 |
| WO | WO 01/62961 | 8/2001 |
| WO | WO 02/072880 | 9/2002 |
| WO | WO 03/057909 | 7/2003 |
| WO | WO 03/080862 A1 | 10/2003 |
| WO | WO 2005/005660 | 1/2005 |
| WO | WO 2005/038051 | 4/2005 |
| WO | WO 2005/098035 | 10/2005 |
| WO | WO 2008/017411 | 2/2008 |
| WO | WO 2009/010776 A1 | 1/2009 |
| WO | WO2009006543 * | 1/2009 |

OTHER PUBLICATIONS

Mund et al, Comparative analysis of DNA methylation patterns in transgenic Drosophila overexpressing mouse DNA methyltransferases, 2004, Biochem. J., 378, 763-764.*
WO0231186—descrition, machine translation in English, pp. 1-12, printed on Jun. 20, 2012.*
Seq Id No. 1 search results, pp. 1-6, printed on Jun. 5, 2012.*
Seq Id No. 36 search results, pp. 1-6, printed on Jun. 5, 2012.*
Kunert et al, A Dnmt2-like protein mediates DNA methylation in Drosophila, Development, 2003, 130, 5083-5090.*
Tang et al, The Eukaryotic DNMT2 Genes Encode a New Class of Cytosine- 5 DNA Methyltransferases, 2003, The Journal of Biological Chemistry, 278, 33613-33616.*
Hermann et al, The Human Dnmt2 Has Residual DNA—(Cytosine-C5) Methyltransferase Activity,2003, The Journal of Biological Chemistry, 278, 31717-31721.*
Ramsahoye et al, Non-CpG methylation is prevalent in embryonic stem cells and may be mediated by DNA methyltransferase 3a, 2000, PNAS, 97, 5237-5242.*
Lorincz et al, CmC(a/t)GG methylation: A new epigenetic mark in mammalian DNA?, 2001, PNAS, 98, 10034-10036.*
Bransteitter et al., "Activation-indicuded cytidine deaminase deaminates deoxycytidine on single-stranded DNA but requires the action of RNase", PNAS 100(7):4102-4107, 2003.
Eads et al., "CpG Island Hypermethylation in Human Colorectal Tumors is not Associated with DNA Methyltransferase Overexpression", Cancer Research 59:2302-2306, 1999.
Fraga et al., "DNA Methylation: A Profile of Methods and Applications", BioTechniques 33:632-649, 2002.
Frommer et al., "A genomic sequencing protocol that yields a positive display of 5-methylcytosine residues in individual DNA strands", PNAS 89:1827-1831, 1992.
Gonzalgo et al., "Rapid quantitation of methylation differences at specific sites using methylation-sensitive single nucleotide primer extension (Ms-SNuPE)", Nucleic Acids Research, 25(12):2529-2531, 1997.
Gut et al., "A procedure for selective DNA alkylation and detection by mass spectrometry", Nucleic Acids Research 23(8):1367-1373, 1995.

(Continued)

*Primary Examiner* — Narayan Bhat
(74) *Attorney, Agent, or Firm* — Lathrop & Gage LLP; James H. Velema, Esq.; Sean M. Coughlin, Esq.

(57) ABSTRACT

The present invention relates to methods and kits for preserving genomic DNA sequence complexity within chemically and/or enzymatically converted DNA by an enzyme or series of enzymes that adds a methyl group to a cytosine outside of CpG dinucleotide sequences of genomic DNA. Further, the present invention relates to methylation analysis of the genomic DNA.

12 Claims, 2 Drawing Sheets

(56) References Cited

OTHER PUBLICATIONS

Heid et al., "Real Time Quantitative PCR", Genome Research 6:986-994, 1996.

Herman et al., "Methylation-specific PCR: A novel PCR assay for methylation status of CpG islands", PNAS 93:9821-9826, 1996.

Karas, "Laser Desorption Ionization of Proteins with Molecular Masses Exceeding 10000Daltons", Anal. Chem. 60:2299-2301, 1988.

Krol et al., "Modulation of Eukaryotic Gene Expression by Complementary RNA or DNA Sequences", BioTechniques 6(10):958-976, 1988.

Millar et al., "Five Not Four: History and Significance of the Fifth Base".

Lander, "Array of hope", Nature Genetics Supplement 21(1):1-60, Supplement, 1999.

Sadri et al., "Rapid analysis of DNA methylation using new restriction enzyme sites created by bisulfite modification", Nucleic Acids Research 24(24):5058-5059, 1996.

Sanger et al., DNA Sequencing with Chain-terminating inhibitors, PNAS 74(12):5463-5467, 1977.

Scarano et al., "The Heterogeneity of Thymine Methyl Group Origin in DNA Pyrimidine Isostichs of Developing Sea Urchin Embryos", Biochemistry 57:1394-1400, 1967.

Toyota et al., "Identification of Differentially Methylated Sequences in Colorectal Cancer by Methylated CpG Island Amplification", Cancer Research 59:2307-2312, 1991.

Trinh et al., "DNA Methylation Analysis by MethyLight Technology", Methods 25:456-462, 2001.

Yu et al., "Specific Inhibition of PCR by Non-Extendable Oligonucleotides Using a 5' to 3' Exonuclease-Deficient DNA Polymerase", BioTechniques 23:714-720, 1997.

Xiong et al., "COBRA: a sensitive and quantitative DNA methylation assay", Nucleic Acids Research 25(12):2532-2534, 1997.

Zon, "Oligonucleotide Analogues as Potential Chemotherapeutic Agents", Pharmaceutical Research 5(9), 1988.

\* cited by examiner

Figure 1A
Septin 9 region HM assay

P1 gttgtttattagttattatgt  [SEQ ID NO: 126]
P2 aaataatcccatccaacta -> (rc) tagttggatgggattattt  [SEQ ID NO: 127]
BL gttattatgttggattttgtggttaatgtgtag  [SEQ ID NO: 128]
PR cgttaaccgcgaaatccg -> (rc) cggatttcgcggttaacg
   [SEQ ID NO: 129]

BL gttattatgttggattttgtggttaatgtgtag      [SEQ ID NO: 128]

P1 gttgtttattagttattatgt->  [SEQ ID NO: 126]
ttcgttgtttattagttattatgtcggatttcgcggttaacgcgtagttggatgggattattc
gg  [SEQ ID NO: 134]
                              [SEQ ID NO: 136] <-atcaacctaccctaataaa
(rc)
                              [SEQ ID NO: 127]  Aaataatcccatccaacta
P2
                    Cggatttcgcggttaacg (rc)
                 PR cgttaaccgcgaaatccg
                    [SEQ ID NO: 129]

Figure 1B
Septin 9 region HM assay with conserved complexity using Cp[AT] methylation to conserve 9 cytosines P1 gCtgttCatCagtCatCatgt  [SEQ ID NO: 130]
P2 aaatGatcccatccaGctG  [SEQ ID NO: 131]
BL gtCatCatgttggattttgtggtCaatgtgCag  [SEQ ID NO: 132]
PR cgttGaccgcgaaatccg  [SEQ ID NO: 133]

BL gtCatCatgttggattttgtggtCaatgtgCag  [SEQ ID NO: 132]

P1 gCtgttCatCagtCatCatgt->  [SEQ ID NO: 130]
ttcgCtgttCatCagtCatCatgtcggatttcgcggtCaacgcgCagCtggatgggatCatttc
gg  [SEQ ID NO: 134]
                              [SEQ ID NO: 137]  <-GtcGacctaccctaGtaaa
(rc)
                              [SEQ ID NO: 131]  aaatGatcccatccaGctG
P2
                    cggatttcgcggtCaacg (rc)
                 PR cgttGaccgcgaaatccg  [SEQ ID NO: 133]

Figure 2

<u>Septin 9- forwardstrand after CpIATJ Methylation</u>
<u>[SEQ ID NO: 8]</u> cgttacccgagttgtaaagggcggCtccCtgtgtCtgccccgCtgCaccgataCaccgag
CtgcgCacggtgccCagcgCagggagaaCaaatgatCatCtgtcCaacgcgccCatttaC
aggtgaggaaaCtaaggCtcCaaCtCaatcgacgCaCtCtgccCttttgattacCagaaa
agtagCaggaCaggtgtcCtgtcccgccCtaccccggccCaCtaagccggCaccccggCt
ccgaccccggCtgtgcccggcgccgccgcggtgcccggcgccgccgcCtcgcccggcgg
ggccgcccggagcgcccgCacCtccgcccgCttcCacCtggccgggccgcccgcccgg
aCtcgggaCtgggaagtgcggcgaCtcccggaacCagcCattggcgcCagcgcggggagC
tgggggtgCagagCtgcgggcgcggcgggCacgCaggcggccccCaccccggcCtggc
CtggtCtggtCtggtCtgcgCtgccgcgcggggcgccccCtccCaggcccggcgcccgc
CagccccgCtccgcCaggtgCagcgCagcgCagggtgggcggggtggggCtcggcgcg
CacgttCacggggcggggaggggcgggtCagggCgggaCaCagccggCtgggccggg
gttCtatgcgCatCtccggggaggggcggggcggggcggggccggggcggggcccggtc
ggtgCaCtcCagacggcgggccgccccCtCttcccgcCttcCtaCtaccggccCaggatt
agcgccCtgggagcgcgcgccccgCtgcCtcgccgcCaCaCtttcCtgggagcggcggcC
acggaggCacCatgaagaagtCttaCtCaggtgggCttcgcgcccggggtggggaggggt
cggtgtcccgggacCagcgCtgCtCacCtgagtgcCtgcggccgggagtggcgaggcgcc
cccggagCtgagcgagtccccgcggcgggCaCaCtgCaggtcgagttcCtccCaggaCag
ggccgCtgtcggccgCtttcgacCtgagccgaccgtcccCtgcgCtgtCtcCagccCtt
gCtcgagtgtcggaggggCtgccCtgggggacgCtccCtCttcCtcgcccCttgCaccCt
cgCaggaatcgCtgaCtttcCaggtcggccgggtgCtttgggtccCtgtgcgtCtgtgtg
ggtgaatggggtcggggCtaggtggaggggtgtcCttgggttCagcCtCtagggCtggtg
gtcCaggccgCagCatcCtttCttcggattCtCttcggtttCtcCtCtaCttagtggggC
acgggacggcCtcCagatgggaccgtcCagCagcgccCaaaCttggcgaCtcggttCac
gttttgcgCtCaggacgccgcccgc

METHODS FOR PRESERVATION OF GENOMIC DNA SEQUENCE COMPLEXITY

CROSS-REFERENCE TO RELATED APPLICATIONS

This application claims priority from European Provisional Patent Application Serial No. 09167075.2 filed on Aug. 3, 2009, which is incorporated herein by reference in its entirety.

INCORPORATION-BY-REFERENCE OF INFORMATION SUBMITTED ELECTRONICALLY

The Sequence Listing comprising SEQ ID NOs: 1 to 135, which is a part of the present disclosure, includes a computer readable file "Complexity_ST25.TXT" generated by U.S. Patent & Trademark Office Patent In version 3.5 software comprising nucleotide and/or amino acid sequences of the present invention. The subject matter of the Sequence Listing is incorporated herein by reference in its entirety.

FIELD OF THE INVENTION

The present invention relates to novel methods and kits for preserving genomic DNA sequence complexity, and more particularly to novel methods and kits for preserving genomic DNA sequence complexity within chemically and/or enzymatically converted DNA by an enzyme or series of enzymes that adds a methyl group to a cytosine outside of CpG dinucleotide sequences of genomic DNA. Further, the present invention relates to nucleic acids of the preserved and treated genomic DNA sequence complexity. In addition, the present invention relates to use of the said methods, nucleic acids, and/or kits.

BACKGROUND ART

It is well known in the art that DNA as well as RNA can be methylated. The base 5-methylcytosine is the most frequent covalently modified base found in the DNA of eukaryotic cells. DNA methylation plays an important biological role in, for example, regulating transcription, genomic imprinting, and tumorigenesis (for review see, e.g., Millar et al.: Five not four: History and significance of the fifth base; in *The Epigenome*, S. Beck and A. Olek (eds.), Wiley-VCH Publishers, Weinheim 2003, pp. 3-20). The identification of 5-methylcytosine is of particular interest in the area of cancer diagnosis. But the identification of methylation is difficult. Cytosine and 5-methylcytosine have the same base-pairing behavior, making 5-methylcytosine difficult to detect using particular standard methods. The conventional DNA analysis methods based on hybridization, for example, are not applicable. In addition, the methylation information is lost completely by the amplification by means of PCR.

Accordingly, current methods for DNA methylation analysis are based on at least two different approaches. The first approach utilizes methylation specific restriction enzymes to distinguish methylated DNA, based on methylation specific DNA cleavage. The second approach comprises selective chemical conversion (e.g., bisulfite treatment; see e.g. WO 2005/038051) of unmethylated cytosines to uracil while methylated cytosines remain unchanged. Uracil has the same base pairing behavior as thymine. It therefore forms base pairs with adenine. Instead, 5-methylcytosine hybridizes with guanine still after bisulfite treatment. It is therewith possible to differentiate between methylated and unmethylated cytosines. Alternatively, cytosine may be converted by enzymes like for example cytidine-deaminase which converts unmethylated cytosine faster as methylated cytosine. An appropriate enzyme is described by Bransteitter et al. (Bransteitter et al.: "Activation-induced cytidine deaminase deaminates deoxycytidine on single-stranded DNA but requires the action of Rnase". PNAS 2003, 100(7): 4102-4107; WO 2005/005660).

The enzymatically or chemically pretreated DNA generated in these approaches is typically sequenced and/or pre-amplified and analyzed in different ways (see, e.g., WO 02/072880 pp. 1 ff; Fraga and Estella: DNA methylation: a profile of methods and applications; Biotechniques, 33:632, 634, 636-49, 2002). A wide range of methods exists to detect genomic DNA methylation, including approaches to detect genome-wide and gene-specific methylation levels. Some embodiments of these methods allow also a quantification of methylation i.e. the determination of the amount of DNA molecules that are methylated or unmethylated at said pre-defined CpG position within a mixture of DNA molecules.

Various methylation assay procedures are known in the art, and can be used in conjunction with the present invention. Most methods used to analyze the methylation state or level of a specific sequence are based on bisulfite modification of the DNA or other reagents with the same treatment behavior as bisulfite. Following the treatment, the methylation status can be assessed as a sequence difference for example by direct sequencing, Pyrosequencing, Next Generation Sequencing, primer extension, COBRA, MLA, MSP, MethyLight, HM, QM, and HQM.

DISCLOSURE OF THE INVENTION

The Problems and its Solution

At least one drawback that the above mentioned methylation methods and analysis face is that unmethylated cytosines are chemically and/or enzymatically converted to uracils which have the same base paring behavior as thymines throughout of the genomic DNA, i.e. unmethylated cytosines within the CpG dinucleotide sequences and outside of the CpG dinucleotide sequences are converted. As a result, the modified genomic DNA sequence mostly reduces to only three bases (A, T, G). This less complex DNA sequence creates problems in DNA sequencing, designing methylation assays, reference sequence mapping, and methylation analysis.

The resulted reduced DNA sequence complexity often makes the development of methylation assays difficult due to diminished flexibility in designing quality PCR assay, sequencing primers, unique probes and blockers, and due to reduced signal strength or abnormally shaped sequencing reactions, in particular on a genome wide scale.

Further, in methylation analysis methods conversion of cytosines to thymines generates poly T stretches that make the sequence signal unreadable and causes PCR dye blobs, sequence reaction to fail, sequence signal to drop suddenly, and overestimation of cytosine signal background. For example, Pyrosequencing can be inaccurate when multiple identical nucleotides, in particular T signals, are sequentially repeated in a DNA strand.

In addition, searching for a chemically and/or enzymatically treated, in particular bisulfite read, is significantly increased relative to the original reference sequence. Unlike normal sequencing, the sense and anti-sense strands of the treated sequences are not complementary to each other because the conversion only occurs on cytosines. As a result, there will be four distinct strands after PCR amplification. During sequencing and in particular shotgun sequencing methods, a bisulfite read is almost equally likely to be derived from any of the four strands. Also, after chemically treated or in particular bisulfite treatment of genomic DNA, the Ts in the bisulfite reads could be mapped to either Cs or Ts in the reference but not vice versa. Furthermore, in the mammalian genome, the frequency of CpG dinucleotides in human genomes is only 1% (Scarano E, Iaccarino M, Grippo P, Parisi E (1967). "The heterogeneity of thymine methyl group origin in DNA pyrimidine isostichs of developing sea urchin embryos". *Proc. Natl. Acad. Sci. USA* 57 (5): 1394-400). Because cytosine methylation occurs almost exclusively at CpG dinucleotides, the majority of Cs in the sense and anti-sense strands will be converted to Ts. Therefore, most chemically and/or enzymatically treated, in particular bisulfite reads from the above two strands will be C-poor. Drastic reduction in overall C content of chemically treated, in particular, bisulfite reads and ultimately C signals causes problems in quantitative assessment of DNA genome and in particular on a genome-wide scale.

It would be desirable to create methods to preserve the complexity of genomic DNA, in particular on genome-wide scale, to reduce poly T signals in methylation analysis of genomic DNA, to avoid reduction in overall C content of bisulfite reads and ultimately C signals in order to have a sensitive and an accurate quantitative assessment of genomic DNA methylation, to reduce the difficulties associated with searching chemically treated, in particular, bisulfite reads and with reference sequence mapping. Ultimately, it is desirable to improve diagnosis, prognosis, and monitoring of cancer or other diseases associated with an alteration of the methylation status and to improve prognosis of unwanted drug side effects, for differentiating of cell types, tissue, or for examination of cell differentiation.

To solve the problems mentioned above, the present invention provides such methods to preserve the complexity of genomic DNA, in particular on genome-wide scale.

SUMMARY OF THE INVENTION

The present invention provides a method for preserving DNA complexity comprising treating a genomic DNA, or a fragment thereof, with an enzyme or series of enzymes that adds a methyl group to a cytosine outside of CpG dinucleotide sequences of the said genomic DNA, or a fragment thereof. In further embodiment, the present invention provides a method for methylation analysis of the genomic DNA.

In another embodiment, the present invention provides a method for obtaining methylation analysis of the a genomic DNA, comprising treating a genomic DNA, or a fragment thereof with an enzyme or series of enzymes that adds a methyl group to a cytosine outside of the CpG dinucleotide sequences of the said genomic DNA, or a fragment thereof; treating the said preserved genomic DNA, or a fragment thereof, with one or more reagents to convert unmethylated cytosine bases to uracil or to another base that is detectably dissimilar to cytosine in terms of hybridization properties; amplifying the preserved and treated genomic DNA by means of an amplification enzyme and at least one oligonucleotide which is identical, is complementary, or hybridizes under stringent or highly stringent conditions to at least 9 base long segment of the treated and preserved genomic DNA, and detecting the methylation state or level of at least one CpG dinucleotide of the genomic DNA, or an average, or a value reflecting an average methylation state or level of a plurality of CpG dinucleotides of the genomic DNA based on a presence, absence or amount of, or on a property of said amplificate.

In another embodiment, the present invention provides a method for obtaining methylation analysis of the a genomic DNA sequence, wherein the said genomic DNA comprising at least one target region, said target region comprises of at least 16 contiguous nucleotides selected from a group consist of SEQ ID Nos.: 1 to 7, wherein said contiguous nucleotides comprise at least one CpG dinucleotide sequence. In further embodiment, the target region is consist of at least one gene, its promoter, regulatory elements, or all transcripts variants thereof selected from the group consisting of Septin9, Q9HC74, GSTPi, PITX2, RASSF2A, and SHOX2.

In an embodiment, the present invention provides a method for methylation analysis of the genomic DNA comprising: contacting the preserved and treated said genomic DNA, or the treated fragment thereof, with an amplification enzyme and at least one oligonucleotide, which is identical, is complementary, or hybridizes under stringent or highly stringent conditions to at least 9 base long segment of a sequence selected from SEQ ID NOs: 36 to 63 and SEQ ID NOs: 92 to 119, wherein the preserved and treated genomic DNA or the fragment thereof is either amplified to produce at least one amplificate, or is not amplified; and determining, based on a presence, absence or amount of, or on a property of said amplificate, the methylation state or level of at least one CpG dinucleotide of SEQ ID Nos: 1 to 7, or an average, or a value reflecting an average methylation state or level of a plurality of CpG dinucleotides of SEQ ID Nos.: 1 to 7.

In another embodiment, the present invention provides a method for methylation analysis of the genomic DNA further comprising use of at least one nucleic acid molecule or peptide nucleic acid molecule comprising in each case a contiguous sequence at least 9 nucleotides in length that is complementary to a sequence selected from the group consisting of SEQ ID NO: 36 to 63 and SEQ ID NO: 92 to 119, and complements thereof, wherein said nucleic acid molecule or peptide nucleic acid molecule suppresses amplification of the nucleic acid to which it is hybridized.

In an another embodiment, the present invention provides a method for methylation analysis of the genomic DNA further comprising at least one such hybridized nucleic acid molecule or peptide nucleic acid molecule is bound to a solid phase. In an another embodiment, the present invention provides a method for methylation analysis of the genomic DNA further comprising extending at least one such hybridized nucleic acid by at least one nucleotide base.

In another embodiment, the present invention provides a method for methylation analysis of the genomic DNA wherein the said above amplification comprises use of at least one method selected from the group comprising: use of a heat-resistant DNA polymerase as the amplification enzyme; use of polymerase lacking 5'-3' exonuclease activity; use of a polymerase chain reaction (PCR); generation of an amplificate nucleic acid molecule carrying a detectable label.

In another embodiment the said amplification comprises use of methylation-specific primers. In another embodiment the said detection comprises sequencing of amplificate.

In another embodiment, further detecting, monitoring, prognosis and/or classifying cell proliferative disorders is, at least in part, afforded. In further embodiment, the said cell proliferative disorder is hepatocellular, colorectal, lung, breast, or prostate cell proliferative disorders.

In further embodiment, the said genomic DNA is isolated from a group comprising cell lines, histological slides, biopsies, paraffin-embedded tissue, body fluids, stool, colonic effluent, urine, blood plasma, blood serum, whole blood, isolated blood cells, cells isolated from the blood and combinations thereof.

In further embodiment of the present invention, the reagent is a solution of a bisulfite, hydrogen sulfite or disulfite.

In further embodiment, the present invention discloses a nucleic acid comprising at least 16 contiguous nucleotides of a DNA sequence selected from the group consisting of SEQ ID Nos.: 8 to 119, and sequences complementary thereto. In further embodiment of the present invention the said nucleic acid contiguous base sequence comprises at least one CpG, TpG or CpA dinucleotide sequence.

In further embodiment, the present invention discloses a kit suitable for performing the methods according to the invention comprising (a) an enzyme or series of enzymes that adds a methyl group to a cytosine outside of the CpG dinucleotide sequences of the said genomic DNA, or a fragment thereof; (b) containers suitable for containing the said enzyme and the biological sample of the patient; and optionally (c) instructions for use and interpretation of the kit results.

In further embodiment of the present invention the said kit further comprising one or more reagents to convert unmethylated cytosine bases to uracil or to anther base that is detectably dissimilar to cytosine in terms of hybridization properties.

In a further embodiment of the present invention the said kit further comprising at least one oligonucleotide which is identical, is complementary, or hybridizes under stringent or highly stringent conditions to at least 9 base long segment of a sequence selected from SEQ ID NOs.: 36-63 and SEQ ID NOs: 92 to 119.

In further embodiment, the present invention discloses use of the methods, nucleic acids and kits according to the present invention in the diagnosis, prognosis, monitoring and/or classification of cellular proliferative disorders. In a further embodiment, the said cellular proliferative disorder is hepatocellular, colorectal, breast, lung, or prostate proliferative disorder.

Additional embodiments provide use of the methods, nucleic acids, and/or kits for methylation analysis of the genomic DNA, for diagnosis of cancer or other diseases associated with an alteration of the methylation status, and for prognosis of unwanted drug side effects, for differentiating of cell types, tissue, or for examination of cell differentiation, in particular hepatocellular, colorectal, breast, lung, or prostate proliferative disorder.

BRIEF DESCRIPTION OF THE DRAWINGS

Those of skill in the art will understand that the drawings, described below, are for illustrative purposes only. The drawings are not intended to limit the scope of the present teachings in any way.

FIG. 1A. Illustrates a conventional Heavymethyl assay for a segment of Septin9 region which its complexity is not preserved according to the present invention. "P" stands for primer, "BL" stands for Blocker, "PR" stands for probe, and "rc" stands for reverse complement.

FIG. 1B. Illustrates a Heavymethyl assay designed for methylation analysis according to the present invention. The analyzed segment of Septin9 region is both preserved and bisulfite treated. Further, FIG. 1B shows that nine cytosines within the segment of Septin9 region of SEQ ID NO.: 1 have been preserved or conserved according to the method of invention to achieve the above said advantages.

FIG. 2. Illustrates treatment of Septin9 region—forward strand—after Cp[AT] methylation. Artificially methylated cytosines are portrayed as "C" in capital letter.

DETAILED DESCRIPTION OF THE INVENTION

Definitions:

"Complexity" in the dinucleotide sequences of present invention is meant to be a measure for the similarity of a given sequence to a random or stochastic sequence; the more complex a sequence is the more it is similar to a random sequence. A reduced complexity of the genomic DNA means there are less degrees of variation, e.g most of the bases reduce to A, T, G. Where there are essentially only three different nucleotides rather than four, the probability of a sequence to occur twice in a given length of sequence is much higher.

"Preserving genomic DNA complexity" refers to avoiding or reducing complexity reduction of the genomic DNA. "Preserved genomic DNA" or "preserved DNA" in the context of the current application refers to preserved genomic DNA sequence complexity according to the method of the present invention.

Capital letter "C" in the context of DNA sequences refers to methylated cytosine residue or is a target for methylation via an enzyme or enzymes that adds a methyl group to a cytosine outside of CpG dinucleotide sequence of a genomic DNA.

"Alu Methyltransferase" is a known enzyme from *E. coli* strain that carries the cloned AluI modification gene from *Arthrobacter luteus*. Alu Methyltransferase modifies the cytosine residue ($C^5$) in the sequence below (agCt and tCga):

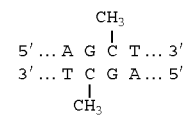

"HaeIII Methyltransferase" is a known enzyme from *E. coli* strain that carries the cloned HaeIII modification gene from *Haemophilus aegyptius*. HaeIII Methyltransferase modifies the internal cytosine residue ($C^5$) in the sequence below (ggCc and cCgg):

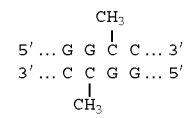

"MspI Methyltransferase" is a known enzyme from an *E. coli* strain that carries the cloned MspI modification gene from *Moraxella* species. MspI Methyltransferase modifies the external cytosine residue ($C^5$) in the sequence below (Ccgg and ggcC):

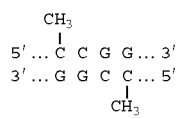

"Dnmt2" belongs to a widely conserved family of putative DNA methyltransferases derived from the *Drosophila* genome. Dnmt2 methylates the cytosine residue at CpT and CpA dinucleotides "Cp[AT]".

The term "Observed/Expected Ratio" ("O/E Ratio") refers to the frequency of CpG dinucleotides within a particular DNA sequence, and corresponds to the [number of CpG sites/(number of C bases×number of G bases)]/band length for each fragment.

The term "CpG island" refers to a contiguous region of genomic DNA that satisfies the criteria of (1) having a frequency of CpG dinucleotides corresponding to an "Observed/Expected Ratio">0.6, and (2) having a "GC Content">0.5. CpG islands are typically, but not always, between about 0.2 to about 1 KB, or to about 2 kb in length.

The term "methylation state" or "methylation status" refers to the presence or absence of 5-methylcytosine ("5-mCyt") at one or a plurality of CpG dinucleotides within a DNA sequence. Methylation states at one or more particular CpG methylation sites (each having two CpG dinucleotide sequences) within a DNA sequence include "unmethylated," "fully-methylated" and "hemi-methylated."

The term "methylation level" or "level of methylation" refers to the degree of 5 methylcytosine ("5-mCyt") at one or a plurality of CpG dinucleotides within a DNA sequence wherein one or more DNA molecules are considered.

The term "hemi-methylation" or "hemimethylation" refers to the methylation state of a double stranded DNA wherein only one strand thereof is methylated.

The term "microarray" refers broadly to both "DNA microarrays," and 'DNA chip(s),' as recognized in the art, encompasses all art-recognized solid supports, and encompasses all methods for affixing nucleic acid molecules thereto or synthesis of nucleic acids thereon.

"Genetic parameters" are mutations and polymorphisms of genes and sequences further required for their regulation. To be designated as mutations are, in particular, insertions, deletions, point mutations, inversions and polymorphisms and, particularly preferred, SNPs (single nucleotide polymorphisms).

"Epigenetic parameters" are, in particular, cytosine methylation. Further epigenetic parameters include, for example, the acetylation of histones which, however, cannot be directly analyzed using the described method but which, in turn, correlate with the DNA methylation.

The term "bisulfite reagent" refers to a reagent comprising bisulfite, disulfite, hydrogen sulfite or combinations thereof, useful as disclosed herein to distinguish between methylated and unmethylated CpG dinucleotide sequences.

The term "Methylation assay" refers to any assay for determining the methylation state of one or more CpG dinucleotide sequences within a sequence of DNA.

The term "hybridisation" is to be understood as a bond of an oligonucleotide to a complementary sequence along the lines of the Watson-Crick base pairings in the sample DNA, forming a duplex structure.

The term "hypermethylation" refers to the average methylation state corresponding to an increased presence of 5-mCyt at one or a plurality of CpG dinucleotides within a DNA sequence of a test DNA sample, relative to the amount of 5-mCyt found at corresponding CpG dinucleotides within a normal control DNA sample.

The term "hypomethylation" refers to the average methylation state corresponding to a decreased presence of 5-mCyt at one or a plurality of CpG dinucleotides within a DNA sequence of a test DNA sample, relative to the amount of 5-mCyt found at corresponding CpG dinucleotides within a normal control DNA sample.

Primer extension: Several embodiments of the primer extension method exist. These methods are based on the conversion of unmethylated cytosines to uracil while methylated cytosines remain unchanged by means of bisulfite. The resulting converted DNA is then subjected to pre-amplification, in particular PCR. Thereafter a methylation specific elongation of a primer is carried out. The binding site of said primer is located up to 10 bases before the cytosine position to be analyzed, is adjacent to it, or encompasses it. After hybridization the primer is elongated by one up to 10 nucleotides. The said methods are for example described in U.S. Pat. No. 6,251,594, WO 01/62961, WO 01/062960, and WO 01/062064.

QM (Quantitative Methylation) method: According to this method, DNA is subjected to treatment, wherein methylated cytosine remains unchanged and unmethylated cytosine is converted to uracil or another base having different base pairing behaviour than cytosine. The converted DNA is then subjected to a real time PCR amplification in the presence of two probe systems. One probe system is specific for the case of methylation of the CpG positions of interest. The other probe system is specific for the case the CpG positions of interest are not methylated. Suitable probe systems are for example Taqman probes or LightCycler probes. In case of Taqman probes, each probes system consist of one probe. In case in of Lightcycler probes, each probe system consists of two probes acting cooperatively. By means of the said probe systems, the amplification products derived from correspondent converted methylated or unmethylated DNA are detected during amplification. From this, the amount of orignal DNA being methylated or being unmethylated is deduced. The QM method is for example described in WO 2005/098035.

HQM (Heavy Quantitative Methylation) method: According to this method, unmethylated cytosines of a double stranded DNA are converted to uracil or a base having a different base pairing behaviour than cytosine while methylated cytosine remains unchanged. In preferred embodiments of the HQM method both converted strands are subjected to methylation analysis, in particular wherein originally reverse complementary regions are analysed in the subjected DNA. In particular preferred is the analysis of both converted DNA strands in methylation specific reactions. Such reactions may be: PCR, isothermal amplification, LCR, MSP, HeavyMethyl, bisulfite sequencing, microarrays, methylation specific restriction enzymes, real-time PCR, HeavyMethyl, MethyLight, QM, methylation sensitive primer extension. The HQM method is described in detail in WO 2008/017411.

The term "MethyLight™ " refers to the art-recognized fluorescence-based real-time PCR technique described by Eads et al., *Cancer Res.* 59:2302-2306, 1999. According to this method, DNA is treated with a modifying agent wherein unmethylated cytosines become modified. Thereafter the treated DNA is analyzed by real-time PCR with one or more probe. The binding site of said probe or probes comprises one or more CpG positions. Thus, the amount of amplification product derived either from DNA with methylated CpG positions or from DNA with unmethylated CpG positions is detected during amplification. From this, the amount of original DNA being methylated or unmethylated at the analysed CpG positions is deduced. Suitable probe systems for analysis are Taqman probe, LightCycler probes or Scorpion primers. The MethyLight method is for example described in WO 00/70090; U.S. Pat. No. 6,331,393; or Trinh et al.: DNA methylation analysis by MethyLight technology. *Methods,* 25:456-62, 2001).

The term "HeavyMethyl™" assay or "HM", in the embodiment thereof implemented herein, refers to an assay, wherein methylation specific blocking probes (also referred to herein as blockers) covering CpG positions between, or covered by the amplification primers enable methylation-specific selective amplification of a nucleic acid sample. According to this method, in a first step, unmethylated cytosines of a DNA are converted to uracil while methylated cytosines remain unchanged. The converted DNA is then subjected to an amplification reaction. The amplification of the converted methylated or unmethylated DNA of interest is detected during the amplification while undesired background DNA is simultaneously suppressed by means of a blocker. Said blocker is either specific for background converted methylated DNA or background converted unmethylated DNA. Preferably, the HM method is carried out as a real time variant. The HM method is described for example in WO 02/072880.

The term "HeavyMethyl™ MethyLight™" assay, in the embodiment thereof implemented herein, refers to a HeavyMethyl™ MethyLight™ assay, which is a variation of the MethyLight™ assay, wherein the MethyLight™ assay is combined with methylation specific blocking probes covering CpG positions between the amplification primers.

The term "Ms-SNuPE" (Methylation-sensitive Single Nucleotide Primer Extension) refers to the art-recognized assay described by Gonzalgo & Jones, *Nucleic Acids Res.* 25:2529-2531, 1997.

The term "MSP" (Methylation-specific PCR) refers to the art-recognized methylation assay described by Herman et al. *Proc. Natl. Acad. Sci. USA* 93:9821-9826, 1996, and by U.S. Pat. No. 5,786,146. According to this method, DNA is treated with bisulfite resulting in a conversion of unmethylated cytosines to uracil while methylated cytosines remain unaltered. After said conversion, the DNA is subjected to PCR amplification by means of methylation-specific primers. The MSP method is for example described in Herman et al.: Methylation specific PCR: a novel PCR assay for methylation status of CpG islands. *Proc Natl Acad Sci USA.* 93:9821-6, 1996. When carried out as a real-time variant, the MSP allows a quantification of amplified products. Thus, it is possible to deduce the amount of subjected DNA being methylated or unmethylated at the cytosine positions of interest.

The term "COBRA" (Combined Bisulfite Restriction Analysis) refers to the art-recognized methylation assay described by Xiong & Laird, *Nucleic Acids Res.* 25:2532-2534, 1997. According to this method, DNA is treated with bisulfite. After the treatment, the DNA is amplified by means of PCR. Thereafter, the amplified DNA is digested by means of restriction enzymes. Said enzymes are specific for bisulfite treated unmethylated sites. Digested or undigested fragments are finally detected for example by gel electrophoresis and in if the case may be hybridization of a specific labeled probe. Methylation levels in the original DNA sample are represented by the relative amounts of digested and undigested PCR product. The COBRA method is for example described in Xiong & Laird, *Nucleic Acids Res.* 25:2532-2534, 1997.

MLA (Methylation Sensitive Ligation and Amplification): According to this method, DNA is subjected to a treatment wherein unmethylated cytosine is converted to uracil, while methylated cytosine remains unchanged. Preferably, said treatment is a treatment with bisulfite. Subsequently, the treated DNA is amplified by means of at least two pairs of essentially complementary probe oligonucleotides. The methylation status of the cytosine of interest in the orignal DNA is deduced from the presence or absence of amplificates. The MLA method is for example described in WO 03/057909.

The term "MCA" (Methylated CpG Island Amplification) refers to the methylation assay described by Toyota et al., *Cancer Res.* 59:2307-12, 1999, and in WO 00/26401A1.

The term "hybridization" is to be understood as a bond of an oligonucleotide to a complementary sequence along the lines of the Watson-Crick base pairings in the sample DNA, forming a duplex structure.

Direct sequencing: This sequencing method uses bisulfite-treated DNA utilized with PCR and standard dideoxynucleotide DNA sequencing directly determine the nucleotides resistant to bisulfite conversion. Primers are designed to be strand-specific as well as bisulfite-specific. Both methylated and unmethylated sequences are amplified. All sites of unmethylated cytosines are portrayed as thymines in the resulting amplified sequence of the sense strand, and as adenines in the amplified antisense strand.

Pyrosequencing: Pyrosequencing is a real-time sequencing technology based on luminometric detection of pyrophosphate release upon nucleotide incorporation which is suited for simultaneous analysis and quantification of the methylation degree of several CpG positions. After bisulfite modification of genomic DNA, a region of interest is amplified by polymerase chain reaction (PCR) with one of the two primers being biotinylated. The PCR-generated template is rendered single stranded and a Pyrosequencing primer is annealed to analyze quantitatively CpG positions. After bisulfite treatment and PCR, the degree of each methylation at each CpG position in a sequence is determined from the ratio of T and C signals reflecting the proportion of unmethylated and methylated cytosines at each CpG site in the original sequence.

The terms "Methylation-specific restriction enzymes" or "methylation-sensitive restriction enzymes" shall be taken to mean an enzyme that selectively digests a nucleic acid dependant on the methylation state of its recognition site. In the case of such restriction enzymes which specifically cut if the recognition site is not methylated or hemimethylated, the cut will not take place, or with a significantly reduced efficiency, if the recognition site is methylated. In the case of such restriction enzymes which specifically cut if the recognition site is methylated, the cut will not take place, or with a significantly reduced efficiency if the recognition site is not methylated. Preferred are methylation-specific restriction enzymes, the recognition sequence of which contains a CG dinucleotide (for instance cgcg or cccggg). Further preferred for some embodiments are restriction enzymes that do not cut if the cytosine in this dinucleotide is methylated at the carbon atom C5. "Non-methylation-specific restriction enzymes" or "non-methylation-sensitive restriction enzymes" are restriction enzymes that cut a nucleic acid sequence irrespective of the methylation state with nearly identical efficiency. They are also called "methylation-unspecific restriction enzymes."

"Stringent hybridization conditions," as defined herein, involve hybridizing at 68° C. in 5×SSC/5×Denhardt's solution/1.0% SDS, and washing in 0.2×SSC/0.1% SDS at room temperature, or involve the art-recognized equivalent thereof (e.g., conditions in which a hybridization is carried out at 60° C. in 2.5×SSC buffer, followed by several washing steps at 37° C. in a low buffer concentration, and remains stable). Moderately stringent conditions, as defined herein, involve including washing in 3×SSC at 42° C., or the art-recognized equivalent thereof. The parameters of salt concentration and temperature can be varied to achieve the optimal level of identity between the probe and the target nucleic acid. Guidance regarding such conditions is available in the art, for example, by Sambrook et al., 1989, Molecular Cloning, A Laboratory Manual, Cold Spring Harbor Press, N.Y.; and Ausubel et al. (eds.), 1995, Current Protocols in Molecular Biology, (John Wiley & Sons, N.Y.) at Unit 2.10.

In reference to composite array sequences, the phrase "contiguous nucleotides" refers to a contiguous sequence region of any individual contiguous sequence of the composite array, but does not include a region of the composite array sequence that includes a "node," as defined herein above.

The term "pre-cancerous" or "pre-neoplastic" and equivalents thereof shall be taken to mean any cellular proliferative disorder which is undergoing malignant transformation. Examples of such conditions include, in the context of colorectal cellular proliferative disorders, cellular proliferative disorders with a high degree of dysplasia and the following classes of adenomas:

Level 1: penetration of malignant glands through the muscularis mucosa into the submucosa, within the polyp head Level 2: the same submucosal invasion, but present at the junction of the head to the stalk Level 3: invasion of the stalk Level 4: invasion of the stalk's base at the connection to the colonic wall (this level corresponds to stage Dukes A)

The term at least one gene or genomic sequence selected from the group consisting of Septin9, Q9HC74, GSTPi, PITX2, RASSF2A, SHOX2 shall be taken to include all transcript variants thereof and all promoter and regulatory elements thereof. Furthermore as a plurality of SNPs are known within said gene the term shall be taken to include all sequence variants.

Methods of the Present Invention

In one preferred aspect of the invention, a method for preserving genomic DNA complexity is provided. This method comprises contacting genomic DNA, or a fragment thereof obtained from a subject with an enzyme or series of enzymes that adds a methyl group to a cytosine outside of CpG dinucleotide sequences of the said genomic DNA, or a fragment thereof.

Genomic DNA of the present invention may be isolated by any means standard in the art, including the use of commercially available kits. Briefly, wherein the DNA of interest is encapsulated in by a cellular membrane the biological sample can be disrupted and lysed by enzymatic, chemical or mechanical means. The DNA solution may then be cleared of proteins and other contaminants, e.g., by digestion with proteinase K. The genomic DNA is then recovered from the solution. This may be carried out by means of a variety of methods including salting out, organic extraction or binding of the DNA to a solid phase support. The choice of method will be affected by several factors including time, expense and required quantity of DNA. All clinical sample types comprising neoplastic matter or pre-neoplastic matter are suitable for use in the present method, preferred are cell lines, histological slides, biopsies, paraffin-embedded tissue, body fluids, stool, colonic effluent, urine, blood plasma, blood serum, whole blood, isolated blood cells, cells isolated from the blood and combinations thereof. Body fluids are the preferred source of the DNA; particularly preferred are blood plasma, blood serum, whole blood, isolated blood cells and cells isolated from the blood.

The said genomic DNA of invention is then treated with an enzyme or series of enzymes that adds a methyl group to a cytosine outside of CpG dinucleotide sequences of the said genomic DNA, or a fragment thereof. The enzymes of the invention are selected so that they do not add a methyl group to a cytosine within the CpG dinucleotide sequences of the genomic DNA. In a preferred embodiment these enzymes are selected from a group comprising AluI Methyltransferase, HaeIII Methyltransferase, MspI Methyltransferase, and DNMT2. The genomic DNA of the invention can be treated with any enzyme with the above said characteristics and by any means standard in the art from natural origin or isolated. It is preferred that the said enzymes are isolated and purified. Isolation and purification from certain bacteria or viruses can be performed by any means standard in the art. Further, it is preferred that the said enzymes are purchased from a provider. However, enzymes with said characteristics can also specifically be designed. At least one advantage of using these enzymes is addition of a methyl group at a precise location. AluI Methyltransferase adds a methyl group to a cytosine in the 5' . . . agCt . . . 3' and to its reverse complement 3' . . . tCga . . . 5'. HaeIII Methyltransferase adds a methyl group to the middle cytosine in the 5' . . . ggCc . . . 3' and to its reverse complement 3' . . . cCgg . . . 5 MspI Methyltransferase recognizes 5' . . . Ccgg . . . 3' and its reverse complement 3' . . . ggcC . . . 5' sequence and adds a methyl group to a cytosine as shown in capital letter. Finally DNMT2 enzyme recognizes CpA and CpT dinucleotide sequences and methylates the cytosines in these sequences. For example, as shown in FIG. 2 for clarity purposes, treating Septin9 gene sequence SEQ ID NO.: 1 with DNMT2 enzyme methylates cytosines in the Cp[AT] sequences. Capital "C" is indicative of the cytosines that have been methylated and preserved to achieve the above said advantages. Further, Table 2 illustrates another advantage of preserving DNA sequence complexity and in particular, preservation of cytosines within the genomic DNA sequence. Table 2 shows the number of conserved or preserved cytosines according to the method of the present invention within Septin9, Q9HC74, GSTPi, PITX2, RASSF2A, and SHOX2. For instances, there are 1229 cytosines within the Septin9 gene—sense strand—region and methylation of cytosines in the Cp[AT] sequences within the said region, conserves or preserves 614 cytosines after the bisulfite treatment, i.e. 614 cytosines are not converted to thymines.

In another preferred method of the invention, the preservation of genomic DNA sequence complexity is achieved by contacting the genomic DNA isolated from a biological sample with an enzyme, or series of enzymes that adds a methyl group to a cytosine outside of the CpG dinucleotide sequences of the said genomic DNA, or a fragment thereof within at least one target region of the genomic DNA. Preferably the target region comprises, or hybridizes under stringent conditions to a sequence of at least 16 contiguous nucleotides of SEQ ID NO. 1 to 7, wherein said contiguous nucleotides comprise at least one CpG dinucleotide sequence.

In another embodiment of the invention, the genomic DNA is treated with an enzyme that methylates the cytosines in the Cp[AT] sequences. The preferred such enzyme is DNMT2. Such treatment converts the SEQ ID NO. 1 to 7 to SEQ ID NOs.: 8 to 14, to SEQ ID NO. 22 to 28, to SEQ ID NOs: 64 to 70, and to SEQ ID NOs: 78 to 84 respectively as described in Table 1.

In further embodiment of the invention, the genomic DNA is treated with an enzyme or series of enzymes that add a methyl group to a cytosine in the AGCT, GGCC, and CCGG. The preferred enzymes are AluI Methyltransferase, HaeIII Methyltransferase, and MspI Methyltransferase. The said treatment converts the SEQ ID NO. 1 to 7 to SEQ ID NOs.: 15 to 21, to SEQ ID NO. 29 to 35, to SEQ ID NOs: 71 to 77, and to SEQ ID NOs: 85 to 91 respectively as described in Table 1.

The above said enzymes according to the method of the present invention can be added alone or in any combination with other enzyme(s) that add methyl groups to the cytosine residue outside of CpG dinucleotide sequence. In another preferred embodiment of the invention, the genomic DNA sequence complexity is substantially or partially preserved. Partial preservation means that not all of the cytosines outside of the CpG dinucleotide sequences are methylated. Substantially preserved means that not all of the cytosines outside of the CpG dinucleotide sequences are methylated due to experimental error, change in reaction conditions, or any other inaccuracies or errors that a person skilled in the art face when performing an experiment.

In another embodiment of the invention, methylation analysis of the genomic DNA is analyzed. It is preferred that the method according to the invention is used for methylation analysis of vertebrates and/or mammalians.

This step of the invention is preferably achieved by means of treatment of the preserved genomic DNA as explained above with one or more reagents to convert cytosine bases that are unmethylated in the 5-position thereof to uracil or to another base that is detectably dissimilar to cytosine in terms of hybridization properties. The preferred reagent is a bisulfite reagent. The term "bisulfite reagent" refers to a reagent comprising bisulfite, disulfite, hydrogen sulfite or combinations thereof, useful as disclosed herein to distinguish between methylated and unmethylated CpG dinucleotide sequences. It is preferred that the bisulfite treatment is conducted in the presence of denaturing solvents such as but not limited to n-alkylenglycol, particularly diethylene glycol dimethyl ether (DME), or in the presence of dioxane or dioxane derivatives. In a preferred embodiment the denaturing solvents are used in concentrations between 1% and 35% (v/v). It is also preferred that the bisulfite reaction is carried out in the presence of scavengers such as but not limited to chromane derivatives, e.g., 6-hydroxy-2,5,7,8,-tetramethylchromane 2-carboxylic acid or trihydroxybenzoe acid and derivates thereof, e.g. Gallic acid. The bisulfite conversion is preferably carried out at a reaction temperature between 30° C. and 70° C., whereby the temperature is increased to over 85° C. for short periods of times during the reaction. It is also possible to conduct the conversion enzymatically, e.g. by use of methylation specific cytidine deaminases (German patent application 103 31 107.6, filing date Jul. 4, 2003, applicant: Epigenomics AG).

In another preferred method of the present invention, the methylation analysis of the said genomic DNA is analyzed comprising treating the said preserved genomic DNA, or a fragment thereof, with one or more reagents to convert unmethylated cytosine bases to uracil or to another base that is detectably dissimilar to cytosine in terms of hybridization properties, amplifying the treated genomic DNA by means of an amplification enzyme and at least one oligonucleotide which is identical, is complementary, or hybridizes under stringent or highly stringent conditions to at least 9 base long segment of treated and preserved genomic DNA, and detecting the methylation state or level of at least one CpG dinucleotide of the genomic DNA, or an average, or a value reflecting an average methylation state or level of a plurality of CpG dinucleotides of the genomic DNA based on a presence, absence or amount of, or on a property of said amplificate.

In another preferred method of the invention, the methylation analysis of the genomic DNA is achieved by contacting the isolated genomic DNA with an enzyme, or series of enzymes that adds a methyl group to a cytosine outside of the CpG dinucleotide sequences of the said genomic DNA within at least one target region of the genomic DNA, wherein the target region comprises, or hybridizes under stringent conditions to a sequence of at least 16 contiguous nucleotides of SEQ ID NO: 1 to 7, wherein said contiguous nucleotides comprise at least one CpG dinucleotide sequence. Then, treating the said preserved genomic DNA with one or more reagents, preferably bisulfite reagents, to convert unmethylated cytosine bases to uracil or to anther base that is detectably dissimilar to cytosine in terms of hybridization properties. Table 2 of the present invention shows number of cytosines conserved in each bisulfite treated strand after cytosine methylation in the Cp[AT] sequences and GGCC, AGCT, and CCGG sequences and in combination with each other. These template strands with conserved cytosines provide desirable templates for further methylation analysis with the above said advantages.

The disclosed invention further discloses a method for methylation analysis of genomic DNA, preferably, the analysis is based on a presence, absence or amount of, or on a property of amplificates, the methylation state or level of at least one CpG dinucleotide of the genomic DNA or an average, or a value reflecting an average methylation state or level of a plurality of CpG dinucleotides of the genomic DNA. In particular a method for methylation analysis of Septin 9, Q9HC74, GSTPi, PITX2, RASSF2A, SHOX2 and more in particular SEQ ID NO. 1 to 7, or an average, or a value reflecting an average methylation state or level of a plurality of CpG dinucleotides of SEQ ID NO. 1 to 7.

The present invention provides for the use of the bisulfite technique, in combination with one or more methylation assays, for determination of the methylation status of CpG dinucleotide sequences within SEQ ID NO: 1 to 7. Genomic CpG dinucleotides can be methylated or unmethylated (alternatively known as up- and down-methylated respectively). However the methods of the present invention are suitable for the analysis of biological samples of a heterogeneous nature e.g. a low concentration of tumor cells within a background of blood or stool. Accordingly, when analyzing the methylation status of a CpG position within such a sample the person skilled in the art may use a quantitative assay for determining the level (e.g. percent, fraction, ratio, proportion or degree) of methylation at a particular CpG position as opposed to a methylation state. Accordingly the term methylation status or methylation state should also be taken to mean a value reflecting the degree of methylation at a CpG position. Unless specifically stated the terms "hypermethylated" or "upmethylated" shall be taken to mean a methylation level above that of a specified cut-off point, wherein said cut-off may be a value representing the average or median methylation level for a given population, or is preferably an optimized cut-off level. The "cut-off" is also referred herein as a "threshold". In the context of the present invention the terms "methylated", "hypermethylated" or "upmethylated" shall be taken to include a methylation level above the cut-off be zero (0) % (or equivalents thereof) methylation for all CpG positions within and associated with (e.g. in promoter or regulatory regions) the Septin 9 gene.

According to the present invention, determination of the methylation status of CpG dinucleotide sequences within SEQ ID NO: 1 to 7 has utility both in the diagnosis and characterization of cellular proliferative disorders.

Methylation Assay Procedures

Various methylation assay procedures are known in the art, and can be used in conjunction with the present invention. These assays allow for determination of the methylation state of one or a plurality of CpG dinucleotides (e.g., CpG islands) within a DNA sequence. Such assays involve, among other techniques, DNA sequencing of bisulfite-treated DNA, PCR (for sequence-specific amplification), Southern blot analysis, and Pyrosequencing.

For example, genomic sequencing has been simplified for analysis of DNA methylation patterns and 5-methylcytosine distribution by using bisulfite treatment (Frommer et al., *Proc. Natl. Acad. Sci. USA* 89:1827-1831, 1992). Additionally, restriction enzyme digestion of PCR products amplified from bisulfite-converted DNA is used, e.g., the method described by Sadri & Hornsby (*Nucl. Acids Res.* 24:5058-5059, 1996), or COBRA (Combined Bisulfite Restriction Analysis) (Xiong & Laird, *Nucleic Acids Res.* 25:2532-2534, 1997).

It is particularly preferred that said reagent converts cytosine bases which are unmethylated at the 5'-position to uracil, thymine, or another base which is dissimilar to cytosine in terms of hybridization behavior. However in an alternative embodiment said reagent may be a methylation sensitive restriction enzyme.

Wherein the preserved genomic DNA sample is treated in such a manner that cytosine bases which are unmethylated at the 5'-position are converted to uracil, thymine, or another base which is dissimilar to cytosine in terms of hybridization behavior. It is preferred that this treatment is carried out with bisulfite (hydrogen sulfite, disulfite) and subsequent alkaline hydrolysis. Such a treatment results in the conversion of SEQ ID NO: 8 to 35 and SEQ ID NO: 64 to 91 to SEQ ID NO: 36 to SEQ ID NO: 63 and to SEQ ID NO: 92 to 119, respectively.

The treated preserved genomic DNA is then analyzed in order to determine the methylation state of the target gene sequences. It is particularly preferred that the target region comprises, or hybridizes under stringent conditions to at least 16 contiguous nucleotides of Septin 9 or its truncated transcript Q9HC74, PITX2, SHOX2, GSTPi, and RASSF2a. It is preferred that the sequence of said gene according to SEQ ID NO: 1 to 7 is analyzed. The method of analysis may be selected from those known in the art, including those listed herein. Particularly preferred are MethyLight, MSP and the use of blocking oligonucleotides (HeavyMethyl) as described herein. It is further preferred that any oligonucleotides used in such analysis (including primers, blocking oligonucleotides and detection probes) should be reverse complementary, identical, or hybridize under stringent or highly stringent conditions to an at least 16-base-pair long segment of the base sequences of one or more of SEQ ID NO: 36-63 and SEQ ID NO: 92-119 and sequences complementary thereto.

Aberrant methylation, more specifically hypermethylation of Septin 9, Q9HC74, PITX2, SHOX2, GSTPi, and RASSF2A (including their truncated transcript, as well as promoter and/or regulatory regions) is associated with the presence of neoplastic cellular proliferative disorders, and is particularly prevalent in colorectal and hepatocellular (Septin9 and Q9HC74), lung (SHOX2), breast (PITX2), prostate (GSTPi) and colon and prostate (RASSF2A) and pro carcinomas. Accordingly wherein a biological sample presents within any degree of methylation, said sample should be determined as neoplastic.

Another aspect of the invention relates to a kit for use in methylation analysis.

Further Improvements

The present invention provides novel uses for the preserved genomic sequence SEQ ID No. 8 to 119. Additional embodiments provide modified variants of SEQ ID NO: 8 to 119, as well as oligonucleotides and/or pna-oligomers for analysis of cytosine methylation patterns within SEQ ID NO: 1 TO 7.

An objective of the invention comprises analysis of the methylation state of one or more CpG dinucleotides within SEQ ID NO: 1 TO 7 and sequences complementary thereto.

The disclosed invention provides preserved nucleic acids and treated preserved nucleic acids, derived from genomic SEQ ID NO: 1 to SEQ ID NO: 7, wherein preservation occurs by an enzyme or series of an enzymes that adds a methyl group to a cytosine outside of a CpG dinucleotide sequence and wherein the treatment of preserved nucleic acid is suitable to convert at least one unmethylated cytosine base of the genomic DNA sequence to uracil or another base that is detectably dissimilar to cytosine in terms of hybridization. The genomic sequences in question may comprise one, or more consecutive methylated CpG positions. Said preservation preferably comprises use of AluI Methyltransferase, HaeIII Methyltransferase, MspI Methyltransferase and DNMT2. Said treatment preferably comprises use of a reagent selected from the group consisting of bisulfite, hydrogen sulfite, disulfite, and combinations thereof. In a preferred embodiment of the invention, the invention provides a non-naturally occurring modified nucleic acid comprising a sequence of at least 16 contiguous nucleotide bases in length of a sequence selected from the group consisting of SEQ ID NO: 8 TO SEQ ID NO: 119. In further preferred embodiments of the invention said nucleic acid is at least 50, 100, 150, 200, 250 or 500 base pairs in length of a segment of the nucleic acid sequence disclosed in SEQ ID NO: 8 to SEQ ID NO: 119. Particularly preferred is a nucleic acid molecule that is not identical or complementary to all or a portion of the sequences SEQ ID NO: 8 to SEQ ID NO: 119 but not SEQ ID NO: 1 to SEQ ID NO: 7 or other naturally occurring DNA.

It is preferred that said sequence comprises at least one CpG, TpA or CpA dinucleotide and sequences complementary thereto. The sequences of SEQ ID NO: 8 TO SEQ ID NO: 119 provide non-naturally occurring modified versions of the nucleic acid according to SEQ ID NO: 1 TO SEQ ID NO: 7, wherein the modification of each genomic sequence results in the synthesis of a nucleic acid having a sequence that is unique and distinct from said genomic sequence as follows.

Significantly, heretofore, the nucleic acid sequences and molecules according SEQ ID NO: 8 to SEQ ID NO: 119 were not implicated in or connected with the detection, classification or treatment of cellular proliferative disorders.

In an alternative preferred embodiment, the invention further provides oligonucleotides or oligomers suitable for use in the methods of the invention for detecting the cytosine methylation state. Said oligonucleotide or oligomer comprising a nucleic acid sequence having a length of at least nine (9) nucleotides which is identical to, hybridizes, under moderately stringent or stringent conditions (as defined herein above), to a treated nucleic acid sequence according to SEQ ID NO: 36-63 to SEQ ID NO: 92-119 and/or sequences complementary thereto, or to a genomic sequence according to SEQ ID NO: 36-63 to SEQ ID NO: 92-119 and/or sequences complementary thereto.

Thus, the present invention includes nucleic acid molecules (e.g., oligonucleotides and peptide nucleic acid (PNA) molecules (PNA-oligomers)) that hybridize under moderately stringent and/or stringent hybridization conditions to all or a portion of the sequences SEQ ID NO: 36-63 to SEQ ID NO: 92-119 or to the complements thereof. Particularly preferred is a nucleic acid molecule that hybridizes under moderately stringent and/or stringent hybridization conditions to all or a portion of the sequences SEQ ID NO: 36-63 to SEQ ID NO: 92-119 but not SEQ ID NO: 1 to SEQ ID NO: 7 or other human genomic DNA.

The identical or hybridizing portion of the hybridizing nucleic acids is typically at least 9, 16, 20, 25, 30 or 35 nucleotides in length. However, longer molecules have inventive utility, and are thus within the scope of the present invention.

Preferably, the hybridizing portion of the inventive hybridizing nucleic acids is at least 95%, or at least 98%, or 100% identical to the sequence, or to a portion thereof of SEQ ID NO: 36-63 to SEQ ID NO: 92-119, or to the complements thereof.

Hybridizing nucleic acids of the type described herein can be used, for example, as a primer (e.g., a PCR primer), or a diagnostic and/or prognostic probe or primer. Preferably, hybridization of the oligonucleotide probe to a nucleic acid sample is performed under stringent conditions and the probe is 100% identical to the target sequence. Nucleic acid duplex or hybrid stability is expressed as the melting temperature or Tm, which is the temperature at which a probe dissociates from a target DNA. This melting temperature is used to define the required stringency conditions.

For target sequences that are related and substantially identical to the corresponding sequence of SEQ ID NO: 36-63 to SEQ ID NO: 92-119 (such as allelic variants and SNPs), rather than identical, it is useful to first establish the lowest temperature at which only homologous hybridization occurs with a particular concentration of salt (e.g., SSC or SSPE). Then, assuming that 1% mismatching results in a 1° C. decrease in the Tm, the temperature of the final wash in the hybridization reaction is reduced accordingly (for example, if sequences having >95% identity with the probe are sought, the final wash temperature is decreased by 5° C.). In practice, the change in Tm can be between 0.5° C. and 1.5° C. per 1% mismatch.

Examples of inventive oligonucleotides of length X (in nucleotides), as indicated by polynucleotide positions with reference to, e.g., SEQ ID NO: 1, include those corresponding to sets (sense and antisense sets) of consecutively overlapping oligonucleotides of length X, where the oligonucleotides within each consecutively overlapping set (corresponding to a given X value) are defined as the finite set of Z oligonucleotides from nucleotide positions:

n to (n+(X−1));

where n=1, 2, 3, . . . (Y−(X−1));

where Y equals the length (nucleotides or base pairs) of SEQ ID NO: 1 (1405);

where X equals the common length (in nucleotides) of each oligonucleotide in the set (e.g., X=20 for a set of consecutively overlapping 20-mers); and where the number (Z) of consecutively overlapping oligomers of length X for a given SEQ ID NO of length Y is equal to Y−(X−1). For example Z=1405−19=1386 for either sense or antisense sets of SEQ ID NO: 1, where X=20.

Preferably, the set is limited to those oligomers that comprise at least one CpG, TpG or CpA dinucleotide.

Examples of inventive 20-mer oligonucleotides include the following set of 2,261 oligomers (and the antisense set complementary thereto), indicated by polynucleotide positions with reference to SEQ ID NO: 1:

1-20, 2-21, 3-22, 4-23, 5-24, . . . and 1387-1405.

Preferably, the set is limited to those oligomers that comprise at least one CpG, TpG or CpA dinucleotide.

Likewise, examples of inventive 25-mer oligonucleotides include the following set of 2,256 oligomers (and the antisense set complementary thereto), indicated by polynucleotide positions with reference to SEQ ID NO: 1:

1-25, 2-26, 3-27, 4-28, 5-29, . . . and 1383-1405.

Preferably, the set is limited to those oligomers that comprise at least one CpG, TpG or CpA dinucleotide.

The present invention encompasses, for each of SEQ ID NO: 36-63 to SEQ ID NO: 92-119 (sense and antisense), multiple consecutively overlapping sets of oligonucleotides or modified oligonucleotides of length X, where, e.g., X=9, 10, 17, 20, 22, 23, 25, 27, 30 or 35 nucleotides.

The oligonucleotides or oligomers according to the present invention constitute effective tools useful to ascertain genetic and epigenetic parameters of the genomic sequence corresponding to SEQ ID NO: 1. Preferred sets of such oligonucleotides or modified oligonucleotides of length X are those consecutively overlapping sets of oligomers corresponding to SEQ ID NO: 36-63 to SEQ ID NO: 92-119 (and to the complements thereof). Preferably, said oligomers comprise at least one CpG, TpG or CpA dinucleotide. Particularly preferred oligonucleotides or oligomers according to the present invention are those in which the cytosine of the CpG dinucleotide (or of the corresponding converted TpG or CpA dinucleotide) sequences is within the middle third of the oligonucleotide; that is, where the oligonucleotide is, for example, 13 bases in length, the CpG, TpG or CpA dinucleotide is positioned within the fifth to ninth nucleotide from the 5'-end.

The oligonucleotides of the invention can also be modified by chemically linking the oligonucleotide to one or more moieties or conjugates to enhance the activity, stability or detection of the oligonucleotide. Such moieties or conjugates include chromophores, fluorophors, lipids such as cholesterol, cholic acid, thioether, aliphatic chains, phospholipids, polyamines, polyethylene glycol (PEG), palmityl moieties, and others as disclosed in, for example, U.S. Pat. Nos. 5,514,758, 5,565,552, 5,567,810, 5,574,142, 5,585, 481, 5,587,371, 5,597,696 and 5,958,773. The probes may also exist in the form of a PNA (peptide nucleic acid) which has particularly preferred pairing properties. Thus, the oligonucleotide may include other appended groups such as peptides, and may include hybridization-triggered cleavage agents (Krol et al., *BioTechniques* 6:958-976, 1988) or intercalating agents (Zon, *Pharm. Res.* 5:539-549, 1988). To this end, the oligonucleotide may be conjugated to another molecule, e.g., a chromophore, fluorophor, peptide, hybridization-triggered cross-linking agent, transport agent, hybridization-triggered cleavage agent, etc.

The oligonucleotide may also comprise at least one art-recognized modified sugar and/or base moiety, or may comprise a modified backbone or non-natural internucleoside linkage. The oligonucleotides or oligomers according to particular embodiments of the present invention are typically used in 'sets,' which contain at least one oligomer for analysis of each of the CpG dinucleotides of a genomic sequence selected from the group consisting SEQ ID NO: 1 to SEQ ID NO: 7 and sequences complementary thereto, or to the corresponding CpG, TpG or CpA dinucleotide within a sequence of the preserved and treated nucleic acids according to SEQ ID NO: 36-63 to SEQ ID NO: 92-119. However, it is anticipated that for economic or other factors it may be preferable to analyse a limited selection of the CpG dinucleotides within said sequences, and the content of the set of oligonucleotides is altered accordingly.

Therefore, in particular embodiments, the present invention provides a set of at least two (2) (oligonucleotides and/or PNA-oligomers) useful for detecting the cytosine methylation state in preserved and treated genomic SEQ ID NO: 36-63 to SEQ ID NO: 92-119. These probes enable diagnosis, classification and/or therapy of genetic and epigenetic parameters of liver and/or colorectal cell proliferative disorders. The set of oligomers may also be used for detecting single nucleotide polymorphisms (SNPs) in preserved and treated genomic DNA SEQ ID NO: 36-63 to SEQ ID NO: 92-119.

In preferred embodiments, at least one, and more preferably all members of a set of oligonucleotides is bound to a solid phase.

In further embodiments, the present invention provides a set of at least two (2) oligonucleotides that are used as 'primer' oligonucleotides for amplifying DNA sequences of one of SEQ ID NO: 36-63 to SEQ ID NO: 92-119 and sequences complementary thereto, or segments thereof.

It is anticipated that the oligonucleotides may constitute all or part of an "array" or "DNA chip" (i.e., an arrangement of different oligonucleotides and/or PNA-oligomers bound to a solid phase). Such an array of different oligonucleotide- and/or PNA-oligomer sequences can be characterized, for example, in that it is arranged on the solid phase in the form of a rectangular or hexagonal lattice. The solid-phase surface may be composed of silicon, glass, polystyrene, aluminium, steel, iron, copper, nickel, silver, or gold. Nitrocellulose as well as plastics such as nylon, which can exist in the form of pellets or also as resin matrices, may also be used. An overview of the Prior Art in oligomer array manufacturing can be gathered from a special edition of Nature Genetics (*Nature Genetics Supplement*, Volume 21, January 1999, and from the literature cited therein). Fluorescently labelled probes are often used for the scanning of immobilized DNA arrays. The simple attachment of Cy3 and Cy5 dyes to the 5'-OH of the specific probe is particularly suitable for fluorescence labels. The detection of the fluorescence of the hybridised probes may be carried out, for example, via a confocal microscope. Cy3 and Cy5 dyes, besides many others, are commercially available.

It is also anticipated that the oligonucleotides, or particular sequences thereof, may constitute all or part of an "virtual array" wherein the oligonucleotides, or particular sequences thereof, are used, for example, as 'specifiers' as part of, or in combination with a diverse population of unique labeled probes to analyze a complex mixture of analytes. Such a method, for example is described in US 2003/0013091 (U.S. Ser. No. 09/898,743, published 16 Jan. 2003). In such methods, enough labels are generated so that each nucleic acid in the complex mixture (i.e., each analyte) can be uniquely bound by a unique label and thus detected (each label is directly counted, resulting in a digital read-out of each molecular species in the mixture).

It is particularly preferred that the oligomers according to the invention are utilized for at least one of: detection of detection and differentiation between or among subclasses of diagnosis of prognosis of treatment of monitoring of and treatment and monitoring of liver and/or colorectal cell proliferative disorders. This is enabled by use of said sets for the detection or detection and differentiation of one or more of the following classes of tissues: colorectal carcinoma, colon adenoma, inflammatory colon tissue, grade 2 dysplasia colon adenomas less than 1 cm, grade 3 dysplasia colon adenomas larger than 1 cm, normal colon tissue, non-colon healthy tissue and non-colon cancer tissue.

Particularly preferred are those sets of oligomers according to the Examples.

In the most preferred embodiment of the method, the presence or absence of a cellular proliferative disorder, most preferably a neoplastic cellular proliferation or differentiation thereof from benign disorders is determined. This is achieved by analysis of the methylation status of at least one target sequence comprising at least one CpG position said sequence comprising, or hybridizing under stringent conditions to at least 16 contiguous nucleotides of a sequence selected from the group consisting SEQ ID NO: 1 to SEQ ID NO:7 and complements thereof. The present invention further provides a method for ascertaining genetic and/or epigenetic parameters of the genomic sequence according to SEQ ID NO: 1 to SEQ ID NO: 7 within a subject by analyzing cytosine methylation and single nucleotide polymorphisms. Said method comprising contacting a nucleic acid comprising SEQ ID NO: 1 to SEQ ID NO: 7 in a biological sample obtained from said subject with an enzyme or series of enzyme that adds a methyl group to a cytosine group outside of a CpG dinucleotide sequence and then further treating the said nucleic acid with at least one reagent or a series of reagents, wherein said reagent or series of reagents, distinguishes between methylated and non-methylated CpG dinucleotides within the target nucleic acid.

In a preferred embodiment, said method comprises the following steps: In the first step, a sample of the tissue to be analyzed is obtained. The source may be any suitable source, such as cell lines, histological slides, biopsies, paraffin-embedded tissue, body fluids, stool, colonic effluent, urine, blood plasma, blood serum, whole blood, isolated blood cells, cells isolated from the blood and all possible combinations thereof. It is preferred that said sources of DNA are stool or body fluids selected from the group consisting colonic effluent, urine, blood plasma, blood serum, whole blood, isolated blood cells, cells isolated from the blood.

The genomic DNA is then isolated from the sample. Genomic DNA may be isolated by any means standard in the art, including the use of commercially available kits. Briefly, wherein the DNA of interest is encapsulated in by a cellular membrane the biological sample must be disrupted and lysed by enzymatic, chemical or mechanical means. The DNA solution may then be cleared of proteins and other contaminants e.g. by digestion with proteinase K. The genomic DNA is then recovered from the solution. This may be carried out by means of a variety of methods including salting out, organic extraction or binding of the DNA to a solid phase support. The choice of method will be affected by several factors including time, expense and required quantity of DNA.

Wherein the sample DNA is not enclosed in a membrane (e.g. circulating DNA from a blood sample) methods standard in the art for the isolation and/or purification of DNA may be employed. Such methods include the use of a protein degenerating reagent e.g. chaotropic salt e.g. guanidine hydrochloride or urea; or a detergent e.g. sodium dodecyl sulphate (SDS), cyanogen bromide. Alternative methods include but are not limited to ethanol precipitation or propanol precipitation, vacuum concentration amongst others by means of a centrifuge. The person skilled in the art may also make use of devices such as filter devices e.g.ultrafiltration, silica surfaces or membranes, magnetic particles, polystyrol particles, polystyrol surfaces, positively charged surfaces, and positively charged membranes, charged membranes, charged surfaces, charged switch membranes, charged switched surfaces.

Once the nucleic acids have been extracted, the genomic double stranded DNA is used in the analysis.

In the second step of the method, the said genomic DNA of invention is then treated with an enzyme or series of enzymes that adds a methyl group to a cytosine outside of CpG dinucleotide sequences of the said genomic DNA, or a fragment thereof. The enzymes of the invention are selected so that they do not add a methyl group to a cytosine within the CpG dinucleotide sequences of the genomic DNA. In a preferred embodiment these enzymes are selected from a group comprising AluI Methyltransferase, HaeIII Methyltransferase, MspI Methyltransferase, and DNMT2. The genomic DNA of the invention can be treated with any enzyme with the above said characteristics and by any means standard in the art from natural origin or isolated. It is preferred that the said enzymes are isolated and purified from certain bacteria or viruses by any means standard in the art. Further, it is preferred that the said enzymes are purchased from a provider. However, enzymes with said characteristics can specifically be designed. At least one advantage of using these enzymes is addition of a methyl group at a precise location. AluI Methyltransferase adds a methyl group to a cytosine in the 5' . . . agCt . . . 3' and to its reverse complement 3' . . . tCga . . . 5'. HaeIII Methyltransferase adds a methyl group to the middle cytosine in the 5' . . . ggCc . . . 3' and to its reverse complement 3' . . . cCgg . . . 5'. MspI Methyltransferase recognizes 5' . . . Ccgg . . . 3' and its reverse complement 3' . . . ggcC . . . 5' sequence and adds a methyl group to a cytosine as shown in capital letter. Finally DNMT2 enzyme recognizes CpA and CpT dinucleotide sequences and methylates the cytosines in these sequences.

In the third step of the method, the preserved genomic DNA sample is then treated in such a manner that cytosine bases which are unmethylated at the 5'-position are converted to uracil, thymine, or another base which is dissimilar to cytosine in terms of hybridization behavior. This is preferably achieved by means of treatment with a bisulfite reagent. The term "bisulfite reagent" refers to a reagent comprising bisulfite, disulfite, hydrogen sulfite or combinations thereof, useful as disclosed herein to distinguish between methylated and unmethylated CpG dinucleotide sequences. Methods of said treatment are known in the art (e.g. PCT/EP2004/011715, which is incorporated by reference in its entirety). It is preferred that the bisulfite treatment is conducted in the presence of denaturing solvents such as but not limited to n-alkylenglycol, particularly diethylene glycol dimethyl ether (DME), or in the presence of dioxane or dioxane derivatives. In a preferred embodiment the denaturing solvents are used in concentrations between 1% and 35% (v/v). It is also preferred that the bisulfite reaction is carried out in the presence of scavengers such as but not limited to chromane derivatives, e.g., 6-hydroxy-2,5,7,8,-tetramethylchromane 2-carboxylic acid or trihydroxybenzoe acid and derivates thereof, e.g. Gallic acid (see: PCT/EP2004/011715 which is incorporated by reference in its entirety). The bisulfite conversion is preferably carried out at a reaction temperature between 30° C. and 70° C., whereby the temperature is increased to over 85° C. for short periods of times during the reaction (see: PCT/EP2004/011715 which is incorporated by reference in its entirety). The bisulfite treated DNA is preferably purified prior to the quantification. This may be conducted by any means known in the art, such as but not limited to ultrafiltration, preferably carried out by means of Microcon™ columns (manufactured by Millipore™). The purification is carried out according to a modified manufacturer's protocol (see: PCT/EP2004/011715 which is incorporated by reference in its entirety).

In the fourth step of the method, fragments of the treated DNA are amplified, using sets of primer oligonucleotides according to the present invention, and an amplification enzyme. The amplification of several DNA segments can be carried out simultaneously in one and the same reaction vessel. Typically, the amplification is carried out using a polymerase chain reaction (PCR). Preferably said amplificates are 100 to 2,000 base pairs in length. The set of primer oligonucleotides includes at least two oligonucleotides whose sequences are each reverse complementary, identical, or hybridize under stringent or highly stringent conditions to an at least 16-base-pair long segment of the base sequences of one of SEQ ID NO: 36-63 to SEQ ID NO: 92-119 and sequences complementary thereto.

In an alternate embodiment of the method, the methylation status of pre-selected CpG positions within the nucleic acid sequences according to SEQ ID NO: 1 to 7 may be detected by use of methylation-specific primer oligonucleotides. This technique (MSP) has been described in U.S. Pat. No. 6,265,171 to Herman. The use of methylation status specific primers for the amplification of bisulfite treated DNA allows the differentiation between methylated and unmethylated nucleic acids. MSP primers pairs contain at least one primer which hybridizes to a bisulfite treated CpG dinucleotide. Therefore, the sequence of said primers comprises at least one CpG dinucleotide. MSP primers specific for non-methylated DNA contain a "T" at the position of the C position in the CpG. Preferably, therefore, the base sequence of said primers is required to comprise a sequence having a length of at least 9 nucleotides which hybridizes to a preserved and treated nucleic acid sequence according to one of SEQ ID NO: 36-63 to SEQ ID NO: 92-119 and sequences complementary thereto, wherein the base sequence of said oligomers comprises at least one CpG dinucleotide. A further preferred embodiment of the method comprises the use of blocker oligonucleotides (the HeavyMethyl™ assay). The use of such blocker oligonucleotides has been described by Yu et al., *BioTechniques* 23:714-720, 1997. Blocking probe oligonucleotides are hybridized to the bisulfite treated nucleic acid concurrently with the PCR primers. PCR amplification of the nucleic acid is terminated at the 5' position of the blocking probe, such that amplification of a nucleic acid is suppressed where the complementary sequence to the blocking probe is present. The probes may be designed to hybridize to the bisulfite treated nucleic acid in a methylation status specific manner. For example, for detection of methylated nucleic acids within a population of unmethylated nucleic acids, suppression of the amplification of nucleic acids which are unmethylated at the position in question would be carried out by the use of blocking probes comprising a 'CpA' or 'TpA' at the position in question, as opposed to a 'CpG' if the suppression of amplification of methylated nucleic acids is desired.

For PCR methods using blocker oligonucleotides, efficient disruption of polymerase-mediated amplification requires that blocker oligonucleotides not be elongated by the polymerase. Preferably, this is achieved through the use of blockers that are 3'-deoxyoligonucleotides, or oligonucleotides derivitized at the 3' position with other than a "free"

hydroxyl group. For example, 3'-O-acetyl oligonucleotides are representative of a preferred class of blocker molecule.

Additionally, polymerase-mediated decomposition of the blocker oligonucleotides should be precluded. Preferably, such preclusion comprises either use of a polymerase lacking 5'-3' exonuclease activity, or use of modified blocker oligonucleotides having, for example, thioate bridges at the 5'-terminii thereof that render the blocker molecule nuclease-resistant. Particular applications may not require such 5' modifications of the blocker. For example, if the blocker- and primer-binding sites overlap, thereby precluding binding of the primer (e.g., with excess blocker), degradation of the blocker oligonucleotide will be substantially precluded. This is because the polymerase will not extend the primer toward, and through (in the 5'-3' direction) the blocker—a process that normally results in degradation of the hybridized blocker oligonucleotide.

A particularly preferred blocker/PCR embodiment, for purposes of the present invention and as implemented herein, comprises the use of peptide nucleic acid (PNA) oligomers as blocking oligonucleotides. Such PNA blocker oligomers are ideally suited, because they are neither decomposed nor extended by the polymerase.

Preferably, therefore, the base sequence of said blocking oligonucleotides is required to comprise a sequence having a length of at least 9 nucleotides which hybridizes to a treated nucleic acid sequence according to one of SEQ ID NO: 36-63 to SEQ ID NO: 92-119 and sequences complementary thereto, wherein the base sequence of said oligonucleotides comprises at least one CpG, TpG or CpA dinucleotide.

The fragments obtained by means of the amplification can carry a directly or indirectly detectable label. Preferred are labels in the form of fluorescence labels, radionuclides, or detachable molecule fragments having a typical mass which can be detected in a mass spectrometer. Where said labels are mass labels, it is preferred that the labeled amplificates have a single positive or negative net charge, allowing for better delectability in the mass spectrometer. The detection may be carried out and visualized by means of, e.g., matrix assisted laser desorption/ionization mass spectrometry (MALDI) or using electron spray mass spectrometry (ESI).

Matrix Assisted Laser Desorption/Ionization Mass Spectrometry (MALDI-TOF) is a very efficient development for the analysis of biomolecules (Karas & Hillenkamp, *Anal Chem.*, 60:2299-301, 1988). An analyte is embedded in a light-absorbing matrix. The matrix is evaporated by a short laser pulse thus transporting the analyte molecule into the vapor phase in an unfragmented manner. The analyte is ionized by collisions with matrix molecules. An applied voltage accelerates the ions into a field-free flight tube. Due to their different masses, the ions are accelerated at different rates. Smaller ions reach the detector sooner than bigger ones. MALDI-TOF spectrometry is well suited to the analysis of peptides and proteins. The analysis of nucleic acids is somewhat more difficult (Gut & Beck, *Current Innovations and Future Trends,* 1:147-57, 1995). The sensitivity with respect to nucleic acid analysis is approximately 100-times less than for peptides, and decreases disproportionally with increasing fragment size. Moreover, for nucleic acids having a multiply negatively charged backbone, the ionization process via the matrix is considerably less efficient. In MALDI-TOF spectrometry, the selection of the matrix plays an eminently important role. For desorption of peptides, several very efficient matrixes have been found which produce a very fine crystallization. There are now several responsive matrixes for DNA; however, the difference in sensitivity between peptides and nucleic acids has not been reduced. This difference in sensitivity can be reduced, however, by chemically modifying the DNA in such a manner that it becomes more similar to a peptide. For example, phosphorothioate nucleic acids, in which the usual phosphates of the backbone are substituted with thiophosphates, can be converted into a charge-neutral DNA using simple alkylation chemistry (Gut & Beck, *Nucleic Acids Res.* 23: 1367-73, 1995). The coupling of a charge tag to this modified DNA results in an increase in MALDI-TOF sensitivity to the same level as that found for peptides. A further advantage of charge tagging is the increased stability of the analysis against impurities, which makes the detection of unmodified substrates considerably more difficult.

In the fifth step of the method, the amplificates obtained during the fourth step of the method are analyzed in order to ascertain the methylation status of the CpG dinucleotides prior to the treatment.

In embodiments where the amplificates were obtained by means of MSP amplification, the presence or absence of an amplificate is in itself indicative of the methylation state of the CpG positions covered by the primer, according to the base sequences of said primer.

Amplificates obtained by means of both standard and methylation specific PCR may be further analyzed by means of based-based methods such as, but not limited to; array technology and probe based technologies as well as by means of techniques such as sequencing and template directed extension.

In one embodiment of the method, the amplificates synthesized in step four are subsequently hybridized to an array or a set of oligonucleotides and/or PNA probes. In this context, the hybridization takes place in the following manner the set of probes used during the hybridization is preferably composed of at least 2 oligonucleotides or PNA-oligomers; in the process, the amplificates serve as probes which hybridize to oligonucleotides previously bonded to a solid phase; the non-hybridized fragments are subsequently removed; said oligonucleotides contain at least one base sequence having a length of at least 9 nucleotides which is reverse complementary or identical to a segment of the base sequences specified in the present Sequence Listing; and the segment comprises at least one CpG, TpG or CpA dinucleotide. The hybridizing portion of the hybridizing nucleic acids is typically at least 9, 15, 20, 25, 30 or 35 nucleotides in length. However, longer molecules have inventive utility, and are thus within the scope of the present invention.

In a preferred embodiment, said dinucleotide is present in the central third of the oligomer. For example, wherein the oligomer comprises one CpG dinucleotide, said dinucleotide is preferably the fifth to ninth nucleotide from the 5'-end of a 13-mer. One oligonucleotide exists for the analysis of each CpG dinucleotide within a sequence selected from the group consisting SEQ ID NO: 36-63 to SEQ ID NO: 92-119. Said oligonucleotides may also be present in the form of peptide nucleic acids. The non-hybridized amplificates are then removed. The hybridized amplificates are then detected. In this context, it is preferred that labels attached to the amplificates are identifiable at each position of the solid phase at which an oligonucleotide sequence is located.

In yet a further embodiment of the method, the genomic methylation status of the CpG positions may be ascertained by means of oligonucleotide probes (as detailed above) that are hybridized to the bisulfite treated DNA concurrently with the PCR amplification primers (wherein said primers may either be methylation specific or standard).

A particularly preferred embodiment of this method is the use of fluorescence-based Real Time Quantitative PCR (Heid et al., *Genome Res.* 6:986-994, 1996; also see U.S. Pat. No. 6,331,393) employing a dual-labeled fluorescent oligonucleotide probe (TaqMan™ PCR, using an ABI Prism 7700 Sequence Detection System, Perkin Elmer Applied Biosystems, Foster City, Calif.). The TaqMan™ PCR reaction employs the use of a non-extendible interrogating oligonucleotide, called a TaqMan™ probe, which, in preferred embodiments, is designed to hybridize to a CpG-rich sequence located between the forward and reverse amplification primers. The TaqMan™ probe further comprises a fluorescent "reporter moiety" and a "quencher moiety" covalently bound to linker moieties (e.g., phosphoramidites) attached to the nucleotides of the TaqMan™ oligonucleotide. For analysis of methylation within nucleic acids subsequent to bisulfite treatment, it is required that the probe be methylation specific, as described in U.S. Pat. No. 6,331,393, (hereby incorporated by reference in its entirety) also known as the MethyLight™ assay. Variations on the TaqMan™ detection methodology that are also suitable for use with the described invention include the use of dual-probe technology (Lightcycler™) or fluorescent amplification primers (Sunrise™ technology). Both these techniques may be adapted in a manner suitable for use with bisulfite treated DNA, and moreover for methylation analysis within CpG dinucleotides.

In a further preferred embodiment of the method, the fifth step of the method comprises the use of template-directed oligonucleotide extension, such as MS-SNuPE as described by Gonzalgo & Jones, *Nucleic Acids Res.* 25:2529-2531, 1997.

In yet a further embodiment of the method, the fifth step of the method comprises sequencing and subsequent sequence analysis of the amplificate generated in the fourth step of the method (Sanger F., et al., *Proc Natl Acad Sci USA* 74:5463-5467, 1977).

Subsequent to the determination of the methylation state or level of the genomic nucleic acids the presence, absence or class of cellular proliferative disorder is deduced based upon the methylation state or level of at least one CpG dinucleotide sequence of SEQ ID NO: 1 to 7, or an average, or a value reflecting an average methylation state of a plurality of CpG dinucleotide sequences of SEQ ID NO: 1 to 7 wherein methylation is associated with a neoplastic or pre-neoplastic cellular proliferative disorder. Wherein said methylation is determined by quantitative means the cut-off point for determining said the presence of methylation is preferably zero (i.e. wherein a sample displays any degree of methylation it is determined as having a methylated status at the analyzed CpG position). Nonetheless, it is foreseen that the person skilled in the art may wish to adjust said cut-off value in order to provide an assay of a particularly preferred sensitivity or specificity. Accordingly said cut-off value may be increased (thus increasing the specificity); said cut off value may be within a range selected form the group consisting of 0%-5%, 5%-10%, 10%-15%, 15%-20%, 20%-30% and 30%-50%. Particularly preferred are the cut-offs 10%, 15%, 25%, and 30%.

Diagnostic and Prognostic Assays for Cellular Proliferative Disorders

The present invention enables diagnosis of events which are disadvantageous to patients or individuals in which important genetic and/or epigenetic parameters within Septin 9, Q9HC74, PITX2, SHOX2, GSTPi, and RASSF2A may be used as markers. Said parameters obtained by means of the present invention may be compared to another set of genetic and/or epigenetic parameters, the differences serving as the basis for a diagnosis and/or prognosis of events which are disadvantageous to patients or individuals.

More specifically the present invention enables the screening of at-risk populations for the early detection of cancers, most preferably liver cancer and/or colorectal carcinomas. Furthermore, the present invention enables the differentiation of neoplastic (e.g. malignant) from benign (i.e. non-cancerous) cellular proliferative disorders. For example, it enables the differentiation of a colorectal carcinoma from small colon adenomas or polyps. Neoplastic cellular proliferative disorders present decreased methylation (i.e. decreased expression) within the Septin 9 gene, as opposed to said benign disorders which do not.

In particular preferred embodiments, inventive oligomers are used to assess the CpG dinucleotide methylation status or arrays thereof, as well as in kits based thereon and useful for the diagnosis and/or classification of cellular proliferative disorders.

Kits

Another aspect of the present invention relates to kits suitable for performing the methods of the present invention comprising (a) an enzyme or series of enzymes that adds a methyl group to a cytosine outside of the CpG dinucleotide sequences of the said genomic DNA, or a fragment thereof (b) containers suitable for containing the said enzyme and the biological sample of the patient; and optionally (c) instructions for use and interpretation of the kit results. It is further preferred that the kits further comprising one or more reagents to convert unmethylated cytosine bases to uracil or to anther base that is detectably dissimilar to cytosine in terms of hybridization properties. It is further preferred that the kits further comprises at least one set of oligonucleotides wherein said oligonucleotides comprises of one or a plurality of nucleic acids or peptide nucleic acids which are identical, are complementary, or hybridize under stringent or highly stringent conditions to at least 9 base long segment of a sequence selected from SEQ ID NOs.: 8-63.

Moreover, an additional aspect of the present invention is a kit comprising: a means for determining Septin 9, Q9HC74, PITX2, SHOX2, GSTPi, and RASSF2A methylation. The means for determining Septin 9, Q9HC74, PITX2, SHOX2, GSTPi, and RASSF2A methylation comprise preferably an enzyme or series of enzymes that adds a methyl group to a cytosine outside of CpG dinucleotide sequence, a bisulfite-containing reagent; one or a plurality of oligonucleotides consisting whose sequences in each case are identical, are complementary, or hybridise under stringent or highly stringent conditions to a 9 or more preferably 18 base long segment of a sequence selected from SEQ ID NO: SEQ ID NO: 36-63 to SEQ ID NO: 92-119; and optionally instructions for carrying out and evaluating the described method of methylation analysis. In one embodiment the base sequence of said oligonucleotides comprises at least one CpG, CpA or TpG dinucleotide.

In a further embodiment, said kit may further comprise standard reagents for performing a CpG position-specific methylation analysis, wherein said analysis comprises one or more of the following techniques: MS-SNuPE, MSP, MethyLight™, HeavyMethyl, COBRA, and nucleic acid sequencing. However, a kit along the lines of the present invention can also contain only part of the aforementioned components.

In a preferred embodiment the kit may comprise additional bisulfite conversion reagents selected from the group consisting: DNA denaturation buffer; sulfonation buffer;

DNA recovery reagents or kits (e.g., precipitation, ultrafiltration, affinity column); desulfonation buffer; and DNA recovery components.

In a further alternative embodiment, the kit may contain, packaged in separate containers, a polymerase and a reaction buffer optimised for primer extension mediated by the polymerase, such as PCR. In another embodiment of the invention the kit further comprising means for obtaining a biological sample of the patient. Preferred is a kit, which further comprises a container suitable for containing the means for determining methylation of the gene Septin 9 in the biological sample of the patient, and most preferably further comprises instructions for use and interpretation of the kit results. In a preferred embodiment the kit comprises: (a) an enzyme or series of enzymes that adds a methyl group to a cytosine outside of CpG dinucleotide sequence (b) a bisulfite reagent; (c) a container suitable for containing the said bisulfite reagent and the biological sample of the patient; (d) at least one oligonucleotide whose sequences is identical, is complementary, or hybridises under stringent or highly stringent conditions to a 9 or more preferably 18 base long segment of a sequence selected from SEQ ID NO: 36-63 to SEQ ID NO: 92-119 and optionally (e) instructions for use and interpretation of the kit results. In an alternative preferred embodiment the kit comprises: (a) an enzyme or series of enzymes that adds a methyl group to a cytosine outside of CpG dinucleotide sequence (b) a bisulfite reagent; (c) a container suitable for containing the said bisulfite reagent and the biological sample of the patient; (d) at least one oligonucleotides and/or PNA-oligomer having a length of at least 9 or 16 nucleotides which is identical to or hybridises to a pre-treated nucleic acid sequence according to one of SEQ ID NO: 36-63 to SEQ ID NO: 92-119 and sequences complementary thereto; and optionally (e) instructions for use and interpretation of the kit results.

In an alternative embodiment the kit comprises: (a) an enzyme or series of enzymes that adds a methyl group to a cytosine outside of CpG dinucleotide sequence (b) a bisulfite reagent; (c) a container suitable for containing the said bisulfite reagent and the biological sample of the patient; (d) at least one oligonucleotide whose sequences is identical, are complementary, or hybridises under stringent or highly stringent conditions to a 9 or more preferably 18 base long segment of a sequence selected from SEQ ID NO: 36-63 to SEQ ID NO: 92-119; (e) at least one oligonucleotides and/or PNA-oligomer having a length of at least 9 or 16 nucleotides which is identical to or hybridises to a pre-treated nucleic acid sequence according to one of SEQ ID NO: 36-63 to SEQ ID NO: 92-119 and sequences complementary thereto; and optionally (f) instructions for use and interpretation of the kit results.

The kit may also contain other components such as buffers or solutions suitable for blocking, washing or coating, packaged in a separate container. In a preferred embodiment the enzymes are selected from a group comprising AluI Methyltransferase, HaeIII Methyltransferase, MspI Methyltransferase, and DNMT2.

Another aspect of the invention relates to a kit for use in determining the presence of and/or distinguishing between cell proliferative disorders, said kit comprising: a means for measuring the level of transcription of the genes Septin 9, Q9HC74, PITX2, SHOX2, GSTPi, and RASSF2A and a means for determining Septin 9, Q9HC74, PITX2, SHOX2, GSTPi, and RASSF2A methylation.

Typical reagents (e.g., as might be found in a typical COBRA™-based kit) for COBRA™ analysis may include, but are not limited to: PCR primers for Septin 9, Q9HC74, PITX2, SHOX2, GSTPi, and RASSF2A; restriction enzyme and appropriate buffer; gene-hybridization oligo; control hybridization oligo; kinase labeling kit for oligo probe; and labeled nucleotides. Typical reagents (e.g., as might be found in a typical MethyLight™-based kit) for MethyLight™ analysis may include, but are not limited to: PCR primers for the bisulfite converted sequence of the Septin 9, Q9HC74, PITX2, SHOX2, GSTPi, and RASSF2A gene; bisulfite specific probes (e.g. TaqMan™ or Lightcycler™); optimized PCR buffers and deoxynucleotides; and Taq polymerase.

Typical reagents (e.g., as might be found in a typical Ms-SNuPE™-based kit) for Ms-SNuPE™ analysis may include, but are not limited to: PCR primers for specific gene (or bisulfite treated DNA sequence or CpG island); optimized PCR buffers and deoxynucleotides; gel extraction kit; positive control primers; Ms-SNuPE™ primers for the bisulfite converted sequence of the Septin 9 gene; reaction buffer (for the Ms-SNuPE reaction); and labeled nucleotides.

Typical reagents (e.g., as might be found in a typical MSP-based kit) for MSP analysis may include, but are not limited to: methylated and unmethylated PCR primers for the bisulfite converted sequence of the Septin 9, Q9HC74, PITX2, SHOX2, GSTPi, and RASSF2A gene, optimized PCR buffers and deoxynucleotides, and specific probes.

The kit may also contain other components such as buffers or solutions suitable for blocking, washing or coating, packaged in a separate container.

The kit may further comprise one or several of the following components, which are known in the art for DNA enrichment: a protein component, said protein binding selectively to methylated DNA; a triplex-forming nucleic acid component, one or a plurality of linkers, optionally in a suitable solution; substances or solutions for performing a ligation e.g. ligases, buffers; substances or solutions for performing a column chromatography; substances or solutions for performing an immunology based enrichment (e.g. immunoprecipitation); substances or solutions for performing a nucleic acid amplification e.g. PCR; a dye or several dyes, if applicable with a coupling reagent, if applicable in a solution; substances or solutions for performing hybridization; and/or substances or solutions for performing a washing step.

The described invention further provides a composition of matter useful for diagnosis, prognosis, monitoring, detecting, differentiation and distinguishing cell proliferative disorders. Said composition comprising at least one nucleic acid 18 base pairs in length of a segment of the nucleic acid sequence disclosed in SEQ ID NO: 8 to SEQ ID NO: 119, and one or more substances taken from the group comprising: 1-5 mM Magnesium Chloride, 100-500 μM dNTP, 0.5-5 units of taq polymerase, bovine serum albumen, an oligomer in particular an oligonucleotide or peptide nucleic acid (PNA)-oligomer, said oligomer comprising in each case at least one base sequence having a length of at least 9 nucleotides which is complementary to, or hybridizes under moderately stringent or stringent conditions to a pretreated genomic DNA according to one of the SEQ ID NO: 36-63 to SEQ ID NO: 92-119 and sequences complementary thereto. It is preferred that said composition of matter comprises a buffer solution appropriate for the stabilization of said nucleic acid in an aqueous solution and enabling polymerase based reactions within said solution. Suitable buffers are known in the art and commercially available.

In further preferred embodiments of the invention said at least one nucleic acid is at least 50, 100, 150, 200, 250 or 500 base pairs in length of a segment of the nucleic acid sequence disclosed in SEQ ID NO: 36-63 to SEQ ID NO: 92-119.

Example

While the present invention has been described with specificity in accordance with certain of its preferred embodiments, the following example serve only to illustrate the invention and are not intended to limit the invention within the principles and scope of the broadest interpretations and equivalent configurations thereof.

Example 1

In this example as shown in Table 2, methods for preserving DNA sequence complexity of Septin 9, Q9HC74, PITX2, SHOX2, GSTPi, and RASSF2A genes, SEQ ID NO. 1-7 are shown.

Treatment of the said genes with an isolated and purified DNMT2 enzyme causes cytosines outside of the CpG dinucleotide sequence, in particular cytosines in the Cp [AT] sequence, to methylate. Further treatment of the said genes with isolated and purified AluI Methyltransferase, HaeIII Methyltransferase, and MspI Methyltransferase methylates cytosines in the agCt, ggCc, Ccgg, respectively. As shown in Table 2, this causes that not all of the unmethylated cytosines to be converted to uracil and ultimately as explained above to thymine after bisulfite treatment, i.e. preserves the complexity of the DNA sequence. For example according to Table 2, Septin9 sense-strand region has 1229 cytosines and 614 cytosines have been preserved after bisulfite treatment of Cp[AT] methylated Septin9 gene via DNMT2 enzyme and 79 cytosines have been preserved after bisulfite treatment of agCt, ggCc, and Ccgg methylated Septin9 via above-mentioned Methyltransferase enzymes. The preserved cytosines provide the above said advantages.

See Example 2 for DNA and enzymes extraction, isolation, and purification and bisulfite treatment conditions.

Example 2

An assay suitable for the methylation analysis of SEQ ID NO: 1 according to the present invention is designed. The assay was designed to be run on the LightCycler platform (Roche Diagnostics), but other such instruments commonly used in the art are also suitable. The assay was HeavyMethyl assay and the amplificates were designed to be detected by means of Lightcycler style dual probes. Further, a conventional HM assay for the segment of SEQ ID NO.: 1 (SEQ ID NO: 134) was compared with the HM assay according to present invention for the segment of SEQ ID NO.: 1 (SEQ ID NO: 135). For more details refer to FIGS. 1A and 1B.

DNA Extraction, DNMT2 and Bisulfite Treatment
Performing the following step:
Isolating the DNA with QIAGEN Genomic-Tip 500/G or 100/G according to the manufacturer's instructions. Then, preserving and untimely converting the purified genomic DNA via isolated and purified DNMT2 enzyme that adds a methyl group to a cytosine in the Cp[AT] sequences and then with bisulfite. Mixing 2 ug of the DNMT2 treated DNA in 100 ul with 354 µl of bisulfite solution (10.36 g sodium bisulfite & 2.49 g sodium sulfite in 22 ml nuclease-free water) and 146 µl of dioxane containing a radical scavenger (6-hydroxy-2,5,7,8-tetramethylchromane 2-carboxylic acid, 323 mg in 8.2 ml of dioxane). The reaction is as follows:

| Time | Speed | Action |
|---|---|---|
| 3 min | | Water bath 99.9° C. |
| 30 min | 1000 rpm | Thermomixer 60° C. |
| 3 min | | Water bath 99.9° C. |
| 1.5 hour | 1000 rpm | Thermomixer 60° C. |
| 3 min | | Water bath 99.9° C. |
| 3 hour | 1000 rpm | Thermomixer 60° C. |

Subsequently purifying the reaction mixture by ultrafiltration using a Millipore Microcon™ column. The purification is conducted according to the manufacturer's instructions. More specifically for desulfonation and washing:

| Time | Volume | Speed | Action |
|---|---|---|---|
| | 200 µl | | Sterile water to bisulfite reaction; mix, vortex & spin |
| | 400 µl | | Bisulfite mix to Microcon column |
| 20 min | | 14,000 g | Discard tube with flow through; replace with new tube |
| | 400 µl | | Remaining bisulfite mix to the same Microcon filter |
| 20 min | | 14,000 g | Discard tube with flow through; replace with new tube |
| | 400 µl | | 0.2 M NaOH |
| 12 min | | 14,000 g | Discard tube with flow through; replace with new tube |
| | 400 µl | | 0.1 M NaOH |
| 12 min | | 14,000 g | Discard tube with flow through; replace with new tube |
| | 400 µl | | ddH$_2$O |
| 12 min | | 14,000 g | Discard tube with flow through; replace with new tube |
| | 400 µl | | ddH$_2$O |
| 12 min | | 14,000 g | Discard tube with flow through; replace with new tube |

Then adding 50 µl of Bisulfite TE buffer (pre-warmed to 50° C.; 0.1 mM EDTA in 10 mM Tris) to the membrane and incubating for 10 min under agitation (1000 rpm). Inverting the column into a 1.7 ml low-retention tube and spun at 1000 g for 7 minutes to elute the DNA. Finally, determining the DNA concentration by a control gene (HB14) real-time PCR assay.

Amplification

See FIGS. 1A and 1B for amplicons and PCR oligonucleotides Amplicons with "rc" in their names were amplified from the second bisulfite treated strand, others from the first bisulfite strand.

Bisulfite treated Septin 9 region HM assay with conserved complexity using Cp[AT] methylation to conserve 9 cytosines according to the present invention ("C" are indicative of conserved cytosines):

```
Segment of Septin9 region (SEQ ID NO: 1):
ttcgCtgttCatCagtCatCatgtcggatttcgcg      SEQ ID NO: 135
gtCaacgcgCagCtggatgggatCatttcgg Primers:
gCtgttCatCagtCatCatgt                     SEQ ID NO: 130 aaatGatcccatccaGctG                       SEQ ID NO: 131

Blockers:
gtCatCatgttggattttgtggtCaatgtgCag         SEQ ID NO: 132

Probe:
cgttGaccgcgaaatccg                        SEQ ID NO.: 133
```

For comparison reasons, conventional HeavyMethyl assay is as follows (FIG. 1A):
Bisulfite treated Septin9 region of interest HM assay:

```
Segment of Septin9 region (SEQ ID NO:1):
ttcgttgtttattagttattatgtcggatttcgcg    SEQ ID NO: 134
gttaacgcgtagttggatgggattatttcgg Primers:
gttgtttattagttattatgt                  SEQ ID NO: 126 aaataatcccatccaacta                    SEQ ID NO: 127

Blockers:
gttattatgttggattttgtggttaatgtgtag      SEQ ID NO: 128

Probe:
cgttaaccgcgaaatccg                     SEQ ID NO.: 129
```

Amplifying Fragments of using the following conditions in 25 ul reactions:
PCR Reaction:

|  | 1x volume(ul) | Final conc. |
|---|---|---|
| 10X DyNAzyme EXT buffer w/MgCl$_2$ | 2.5 | 1X |
| 2 mM dNTPs | 2.5 | 200 uM each |
| Rev/For primer combo (10 uM stock) | 1.25 | 0.5 uM each |
| DyNAzyme EXT polymerase 1 U/ul | 0.5 | 0.5 unit total |
| Bisulfite Treated DNA (@10 ng/ul) | 2.5-5 | 25-50 ng total |
| DMSO 100% | 0-0.5 | 0-2% |

Cycling Conditions:
3 min 94° C.; 20 s 94° C.; 30 s 54° C.; 45 s 72° C. (38-42 cycles 10 min 72° C.
Purification of the PCR Product
Purifying PCR product with the Montage™ DNA Gel Extraction Kit according the manufacturer's instruction.
TA Cloning
Cloning and propageting the PCR product with the Invitrogen TOPO® TA Cloning kit according to manufacturer's instruction.
Sequencing
Culturing Individual colonies in LB (50 ug Carbenicillin/ml LB for selection) by using 1 ul of overnight culture for colony PCR in a 20 ul volume:

PCR Mix
2.5 ul 10× DyNAzyme buffer
2.5 ul 2 mM dNTPs
1.25 ul M13 F primer (10 uM)
1.25 ul M13R primer (10 uM)
0.25 ul DyNAzyme Polymerase
12.25 ul ddH20
Cycling Conditions:
3 min 94° C.; 1 min 94° C.; 1 min 55° C.; 1 min 72° C. (36 cycles); 10 min 72° C.
Colony PCR amplicon purification and sequencing reads are done using standard protocols. Sequencing primers are one of the amplicon specific primers that generated the initial PCR product.

Other Embodiments

The detailed description set-forth above is provided to aid those skilled in the art in practicing the present invention. However, the invention described and claimed herein is not to be limited in scope by the specific embodiments herein disclosed because these embodiments are intended as illustration of several aspects of the invention. Any equivalent embodiments are intended to be within the scope of this invention. Indeed, various modifications of the invention in addition to those shown and described herein will become apparent to those skilled in the art from the foregoing description which do not depart from the spirit or scope of the present inventive discovery. Such modifications are also intended to fall within the scope of the appended claims.

REFERENCES CITED

All publications, patents, patent applications and other references cited in this application are incorporated herein by reference in their entirety for all purposes to the same extent as if each individual publication, patent, patent application or other reference was specifically and individually indicated to be incorporated by reference in its entirety for all purposes. Citation of a reference herein shall not be construed as an admission that such is prior art to the present invention.

TABLE 1

Genomic sequences according to sequence listing

| SEQ ID NO. | Associated Gene Name | Unmethylated CpG Artificially methylated forward strand at Cp[AT] | Unmethylated CpG Artificially methylated forward strand at ggcC, agCt, Ccgg | Unmethylated CpG Artificially methylated reverse strand at Cp[AT] | Unmethylated CpG Artificially methylated reverse strand at ggcC, agCt, Ccgg | Unmethylated CpG Chemically or enzymatic treated of Artificially methylated forward strand at Cp[AT] | Unmethylated CpG Chemically or enzymatic treated of Artificially methylated forward strand at ggcC, agCt, Ccgg | Unmethylated CpG Chemically or enzymatic treated of Artificially methylated reverse strand at Cp[AT] | Unmethylated CpG Chemically or enzymatic treated of Artificially methylated reverse strand at ggcC, agCt, Ccgg |
|---|---|---|---|---|---|---|---|---|---|
| 1 | Septin9 | 8 | 15 | 22 | 29 | 36 | 43 | 50 | 57 |
| 2 | Q9HC74 | 9 | 16 | 23 | 30 | 37 | 44 | 51 | 58 |
| 3 | GSTPi | 10 | 17 | 24 | 31 | 38 | 45 | 52 | 59 |
| 4 | PITX2 | 11 | 18 | 25 | 32 | 39 | 46 | 53 | 60 |
| 5 | PITX2 | 12 | 19 | 26 | 33 | 40 | 47 | 54 | 61 |
| 6 | RASSF2A | 13 | 20 | 27 | 34 | 41 | 48 | 55 | 62 |
| 7 | SMOX2 | 14 | 21 | 28 | 35 | 42 | 49 | 56 | 63 |

* C is modified (methylated) in the sequence.

TABLE 1

Genomic sequences according to sequence listing

| SEQ ID NO. | Associated Gene Name | Un-methylated CpG Artificially methylated forward strand at Cp[AT] | Unmethylated CpG Artificially methylated forward strand at ggcC, agCt, Ccgg | Unmethylated CpG Artificially methylated reverse strand at Cp[AT] | Unmethylated CpG Artificially methylated reverse strand at ggcC, agCt, Ccgg | Unmethylated CpG Chemically or enzymatic treated of Artificially methylated forward strand at Cp[AT] | Unmethylated CpG Chemically or enzymatic treated of Artificially methylated forward strand at ggcC, agCt, Ccgg | Unmethylated CpG Chemically or enzymatic treated of Artificially methylated reverse strand at Cp[AT] | Unmethylated CpG Chemically or enzymatic treated of Artificially methylated reverse strand at ggcC, agCt, Ccgg |
|---|---|---|---|---|---|---|---|---|---|
| 1 | Septin9 | 8 | 15 | 22 | 29 | 36 | 43 | 50 | 57 |
| 2 | Q9HC74 | 9 | 16 | 23 | 30 | 37 | 44 | 51 | 58 |
| 3 | GSTPi | 10 | 17 | 24 | 31 | 38 | 45 | 52 | 59 |
| 4 | PITX2 | 11 | 18 | 25 | 32 | 39 | 46 | 53 | 60 |
| 5 | PITX2 | 12 | 19 | 26 | 33 | 40 | 47 | 54 | 61 |
| 6 | RASSF2A | 13 | 20 | 27 | 34 | 41 | 48 | 55 | 62 |
| 7 | SHOX2 | 14 | 21 | 28 | 35 | 42 | 49 | 56 | 63 |

| SEQ ID NO. | Associated Gene Name | methylated CpG Artificially methylated forward strand at Cp[AT] | methylated CpG Artificially methylated forward strand at ggcC, agCt, Ccgg | methylated CpG Artificially methylated reverse strand at Cp[AT] | methylated CpG Artificially methylated reverse strand at ggcC, agCt, Ccgg | methylated CpG Chemically or enzymatic treated of Artificially methylated forward strand at Cp[AT] | methylated CpG Chemically or enzymatic treated of Artificially methylated forward strand at ggcC, agCt, Ccgg | methylated CpG Chemically or enzymatic treated of Artificially methylated reverse strand at Cp[AT] | methylated CpG Chemically or enzymatic treated of Artificially methylated reverse strand at ggcC, agCt, Ccgg |
|---|---|---|---|---|---|---|---|---|---|
| 1 | Septin9 | 64 | 71 | 78 | 85 | 92 | 99 | 106 | 113 |
| 2 | Q9HC74 | 65 | 72 | 79 | 86 | 93 | 100 | 107 | 114 |
| 3 | GSTPi | 66 | 73 | 80 | 87 | 94 | 101 | 108 | 115 |
| 4 | PITX2 | 67 | 74 | 81 | 88 | 95 | 102 | 109 | 116 |
| 5 | PITX2 | 68 | 75 | 82 | 89 | 96 | 103 | 110 | 117 |
| 6 | RASSF2A | 68 | 76 | 83 | 90 | 97 | 104 | 111 | 118 |
| 7 | SHOX2 | 70 | 77 | 84 | 91 | 98 | 105 | 112 | 119 |

| Enzymes that add methyl group | SEQ ID NO. forward strand | SEQ ID NO. reverse strand |
|---|---|---|
| Table 1A: sequence recognition cites of enzymes that add methyl group outside of CpG dinucleotide sequence | | |
| Alu Methyltransferease | 120 | 121 |
| HaeII Methyltransferase | 122 | 123 |
| MspI Methyltransferase | 124 | 125 |
| Table 1B: Genomic sequences of oligonucleotides used in a HeavyMethyl assay according to sequence listing | | |
| Artificial primer 1 for Septin9 HM assay unconserved | 126 | |
| Artificial primer 2 for Septin9 HM assay unconserved | 127 | |
| Artificial blocker for Septin9 HM assay unconserved | 128 | |
| Artificial probe for Septin9 HM assay unconserved | 129 | |
| Artificial primer 1 for Septin9 HM assay conserved | 130 | |
| Artificial primer 2 for Septin9 HM assay conserved | 131 | |
| Artificial blocker for Septin9 HM assay conserved | 132 | |
| Artificial probe for Septin9 HM assay conserved | 133 | |
| bisulfited treated segment of Septin 9 sequence for HM assay | 134 | |
| Preserved and bisulfite treated segment of Septin9 for HM assay | 135 | |

\* C is modified (methylated) in the sequence.

TABLE 2

Number of cytosines preserved in each bisulfite strand of the gene sequences

| | Septin9 | Q9HC74 | GSTPi | PITX2 | PITX2 | RASSF2A | SHOX2 |
|---|---|---|---|---|---|---|---|
| Genomic | 1229 | 1623 | 2387 | 704 | 506 | 772 | 1507 |
| Genomic Reverse | 1298 | 1389 | 2089 | 579 | 510 | 861 | 1208 |
| Bisulfite treatment after Cp[AT] methylation | 614 | 901 | 1284 | 281 | 167 | 309 | 800 |
| Bisulfite treatment of reverse after Cp[AT] methylation | 655 | 805 | 1142 | 227 | 149 | 329 | 652 |

TABLE 2-continued

Number of cytosines preserved in each bisulfite strand of the gene sequences

| | Septin9 | Q9HC74 | GSTPi | PITX2 | PITX2 | RASSF2A | SHOX2 |
|---|---|---|---|---|---|---|---|
| Bisulfite treatment of after GgcC, aGCt, CcgG Methylation | 79 | 79 | 148 | 52 | 47 | 60 | 89 |
| Bisulfite treatment of reverse after GgcC, aGCt, CcgG Methylation | 81 | 80 | 145 | 51 | 48 | 61 | 88 |

SEQUENCE LISTING (137 sequences)

SEQ ID NO: 1 - DNA, 1405 bp, Homo sapiens
cgttacccgagttgtaaagggcggctccctgtgtctgccccgctgcaccgatacaccgagctgcgcacggtgcccagcgcagggagaacaaatgatcatctgtccaacgcgcccatttacaggtgaggaaactaaggctccaactcaatcgacgcactctgcccttttgattaccagaaaagtagcaggacaggtgtcctgtcccgccctaccccggcccactaagccggcaccccggctccgacccccggctgtgcccggcgccgccgcggtgcccggcgccgccgcctcgcccggcggggccgcccggagcgcccgcacctccgcccgcttccacctggccgggcccgccccgcccggactcgggactgggaagtgcggcgactcccggaaccagccattggcgccagcgcggggagctgggggtgcagagctgcgggcgcggcgggccacgcaggcggcccccacccccggcctggcctggtctggtctggtctgcgctgccgcgcgggggcgccccctcccaggcccggcgcccgccagccccgctccgccaggtgcagcgcagcgcaggggtgggcgggggtggggctcggcgcgcacgttcacggggcggggagggggcgggtcaggggcgggaccacagccggctgggccggggttctatgcgcatctccggggaggggcggggcgggggcggggccggggcggggcccggtcggtgcactccagacggcgggccgccccctcttcccgccttcctactaccggcccaggattagcgccctgggagcgcgcgccccgctgcctcgccgccacactttcctgggagcggcggccacggaggcaccatgaagaagtcttactcaggtgggcttcgcgcccggggtggggaggggtcggtgtcccgggaccagcgctgctcacctgagtgcctgcggccgggagtggcgaggcgcccccggagctgagcgagtccccgcggcgggcacactgcaggtcgagttcctcccaggacagggccgctgtcgggccgctttcgacctgagccgaccgtcccctgcgctgtctccagcccttgctcgagtgtcggaggggctgccctgggggacgctccctcttcctcgccccttgcaccctcgcaggaatcgctgactttccaggtcggccgggtgctttgggtccctgtgcgtctgtgtgggtgaatggggtcggggctaggtggaggggtgtccttgggttcagcctctagggctggtggtccaggccgcagcatcctttcttcggattctcttcggtttctcctctacttagtggggcacgggacggcctccagatgggaccgtccagcagcgcccaaacttggcgactcgggttcacgttttgcgctcaggacgccgcccgc

SEQ ID NO: 2 - DNA, 2365 bp, Homo sapiens
gtggtcgtggtgggggtgttagctgcaggggtgccctcggtgggtgggagttggtggcctctcgctggtgccatgggactcgcatgttcgccctgcgcccctcggctcttgagcccacaggccgggatcctgcctgccagccgcgtgcgctgccgtttaacccttgcaggcgcagagcgcgcggcggcggtgacagagaactttgtttggctgcccaaatacagcctcctgcagaaggaccctgcgcccggggaaggggaggaatctcttcccctctgggcgcccgccctcctcgccatggcccggcctccacatccgcccacatctggccgcagcggggcgcccggggggaggggctgaggccgcgtctctcgccgtcccctgggcgcgggccaggcggggaggaggggggcgctccggtcgtgtgcccaggactgtcccccagcggccactcgggccccagccccccaggcctggccttgacaggcgggcggagcagccagtgcgagacagggaggccggtgcgggtgcgggaacctgatccgcccgggaggcgggggcggggcgggggcgcagcgcgcggggaggggccggcgcccgccttcctcccccattcattcagctgagccagggggcctaggggctcctccggcggctagctctgcactgcaggagcgcgggcgcggcgccccagccagcgcgcagggcccgggccccgccgggggcgcttcctcgccgctgccctccgcgcgacccgctgcccaccagccatcatgtcggaccccgcggtcaacgcgcagctggatgggatcatttcggacttcgaaggtgggtgctgggctggctgctgcggccgcggacgtgctggagaggaccctgcgggtgggcctggcgcgggacgggggtgcgctgaggggagacgggagtgcgctgaggggagacgggacccctaatccaggcgccctcccgctgagagcgccgcgcgcccccggccccgtgcccgcgccgcctacgtgggggaccctgttaggggcacccgcgtagaccctgcgcgccctcacaggaccctgtgctcgttctgcgcactgccgcctgggtttccttccttttattgttgtttgtgtttgccaagcgacagcgacctcctcgagggctcgcgaggctgcctcggaactctccaggacgcacagtttcactctgggaaatccatcggtcccctccctttggctctccccggcggctctcgggccccgcttggacccggcaacgggatagggaggtcgttcctcacctccgactgagtggacagccgcgtcctgctcgggtggacagccctcccctcccccacgccagtttcggggccgccaagttgtgcagcccgtgggccgggagcaccgaacggacacagcccaggtcgtggcagggtctagagtgggatgtcccatggcccccatccaggcctggggatatcctcatccgcctcccagaatcgggccgtgggggacagaaggggcctgcgtgcgggcagggagagtattttggctctctcctgtcttcggggtttacaaagtgtgttgggacttgcggggctgctctgtccaagcctgggtctggcgtccgcgtctctgagcctgtgagtgcgtgcgctttcctgcgtcctcttgactgccggtgctggggctctgcgtcctgcgtccgcgggagtaaatacagcaggcgaaggggaagctcacacaatggtctccagcgctctggggcagggcttctgaggggcgggcctgcctctgccgggacctggagcccccgcccctcggagaggctcctaggctgacttgggcagagccctctggtgggccgggagggggaaaggctgtgttgaaatgagcaaactgtccaggtgtcaggccaagctgggaggtgaccagcctgaggtcctccccgctccatggccagaaccagggctgacatctgggtgtcctgagcccagctgcccacacggcccacctggggtcagccctatctgagtgggggaggcggggcctcctgggggaccagaactttggctggacgccaagcagagtgccagtggctgttcttcagggctgggcctgaggagggtgtggggcggcgaagggacgggagggggttgtgatccagtggccactggcgctgtgcagagtgtgagctggaaacatcgtagttactttgtcagcttagtggtgaaagccctttttcaggctctatccctttgcatccctgcttcccagagggaggggaggtctgggtctgcagagctgggagggcttgctgttcccgcccccctcccccacaacacctcctcatctggacatctttgggcacatgc

SEQ ID NO: 3 - DNA, 4261 bp, Homo sapiens
aacaagagatcaatatctagaataaatggagatctgcaaatcaacagaaagtaggcagcaaagccaaagaaaatagcctaaggcacagccactaaaaggaacgtgatcatgtcctttgcagggacatgggtggagctggaagccgttagcctcagcaaactcacacaggaacagaaaaccagcgagaccgcatggtctcacttataagtgggagctgaacaatgagaacacatggtcacatggcggcgatcaacacacactggtgcctgttgagcggggtgctggggagggagagtaccaggaagaatagctaagggatactgggcttaatacctgggtgatgggatgatctgtacagcaaaccatcatggcgcacacacctatgtaacaaacctgcacatcctgcacatgtaccccagaacttcaaataaaagttggacggccaggcgtggtggctcacgcctgtaatcccagcactttgggaagccgaggcgtgcagatcacctaaggtcaggagttcgagaccagcccggccaacatggtgaaaccccgtctctactaaaaatacaaaaatcagccagatgtggcacgcacctataattccacctactcgggaggctgaagcagaattgcttgaacccgagaggcggaggttgcagtgagccgccgagatcgcgccactgcactccagcctgggccacagcgtgagactacgtcataaaataaaataaaataacacaaaataaaataaaataaaataaaataaaataaaataataaaataaaataaaataaaataaaataaaataaaataaagcaatttcctttcctctaagcggcctccacccctctcccctgccctgtgaagcgggtgtgcaagctccgggatcgcagcggtcttagggaatttccccccgcgatgtcccggcgcgccagttcgctgcgcacacttcgctgcggtcctcttcctgctgtctgtttactccctaggccccgctggggacctgggaaagagggaaaggcttccccggccagctgcgcggcgactccggggactccagggcgcccctctgcggccgacgcccggggtgcagcggccgccggggctggggccggcgggagtccgcgggaccctccagaagagcggccggcgccgtgactcagcactggggcggagcggggcgggaccacccttataaggctcggaggccgcgaggccttcgctggagtttcgccgccgcagtcttcgccaccagtgagtacgcgcggcccgctccccggggatggggctcagagctcccagcatggggccaacccgcagcatcaggcccgggctcccggcagggctcctcgcccacctcgagacccgggacgggggcctaggggacccaggacgtccccagtgccgttagcggctttcagggggcccggagcgcctcggggagggatgggaccccgggggcggggagggggggcaggctgcgctcaccgcgccttggcatcctcccccgggctccagcaaacttttctttgttcgctgcagtgccgccctacaccgtggtctatttcccagttcgaggtaggagcatgtgtctggcagggaagggaggcaggggctggggctgcagcccacagcccctcgcccacccggagagatccgaacccccttatccctccgtcgtgtggcttttaccccgggcctccttcctgttccccgcctctcccgccatgcctgctccccgccccagtgttgtgtgaaatcttcggaggaacctgtttacctgttccctccctgcactcctgacccctccccgggttgctgcgaggcggagtcggcccggtccccacatctcgtacttctccctccccgcaggccgctgcgcggccctgcgcatgctgctggcagatcagggccagagctggaaggaggaggtggtgaccgtggagacgtggcaggagggctcactcaaagcctcctgcgtaagtgaccatgcccgggcaaggggagggggtgctgggccttagggggctgtgactaggatcgggggacgcccaagctcagtgcccctccctgagccatgcctcccccaacagctatacgggcagctccccaagttccaggacggagacctcaccctgtaccagtccaataccatcctgcgtcacctgggccgcacccttggtgagtcttgaacctccaagtccagggcaggcatgggcaagcctctgcccccggagcccttttgtttaaatcagctgccccgcagccctctggagtggaggaaactgagacccactgaggttacgtagtttgcccaaggtcaagcctgggtgcctgcaatccttgccctgtgccaggctgcctcccaggtgtcaggtgagctctgagcacctgctgtgtggcagtctctcatccttccacgcacatcctcttcccctcctcccaggctggggctcacagacagccccctggttggcccatccccagtgactgtgtgttgatcaggcgcccagtcacgcggcctgctcccctccacccaaccccagggctctatgggaaggaccagcaggaggcagccctggtggacatggtgaatgacggcgtggaggacctccgctgcaaatacatctccctcatctacaccaactatgtgagcatctgcaccagggttgggcactgggggctgaacaaagaaaggggcttcttgtgccctcaccccccttacccctcaggtggcttgggctgaccccttcttgggtcagggtgcaggggctgggtcagctctgggccaggggcccaggggcctgggacaagacacaacctgcacccttattgcctgggacatcaaccagccaagtaacgggtcatgggggcgagtgcaaggacagagacctccagcaactggtggtttctgatctcctggggtggcgagggcttcctggagtagccagaggtggaggaggatttgtcgccagtttctggatggaggtgctggcacttttagctgaggaaaatatgcagacacagagcacatttggggacctgggaccagttcagcagaggcagcgtgtgtgcgcgtgcgtgtgcgtgtgtgtgcgtgtgtgtgtgtacgcttgcatttgtgtcgggtgggtaaggagatagagatgggcgggcagtaggcccaggtcccgaaggccttgaacccactggtttggagtctcctaagggcaatgggggccattgagaagtctgaacagggctgtgtctgaatgtgaggtctagaaggatcctccagagaagccagctctaaagcttttgcaatcatctggtgagagaacccagcaaggatggacaggcagaatggaatagagatgagttggcagctgaagtggacaggatttggtactagcctggttgtggggagcaagcagaggagaatctgggactctggtgtctggcctggggcagacgggggtgtctcaggggctgggagggatgagagtaggatgatacatggtggtgtctggcaggaggcgggcaaggatgactatgtgaaggcactgcccgggcaactgaagccttttgagaccctgctgtcccagaaccagggaggcaagaccttcattgtgggagaccaggtgagcatctggccccatgctgttccttcctcgccaccctctgcttccagatggacacaggtgtgagccatttgtttagcaaagcagagcagacctaggggatgggcttaggccctctgcccccaattcctccagcctgctcccgctggctgagtccctagcccccctgccctgcagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagctactatgagcactgtgtttcctgggacggggcttaggggttctcagcctcgaggtcggtgggagggcagagcagaggactagaaaacagctcctccagcacagtcagtggcttcctggagccctcagcctggctgtgtttactgaacctcacaaactagaagaggaagaaaaaaaaagagagagagaaacaaagagaaata

SEQ ID NO: 4 - DNA, 6343 bp, Homo sapiens
gattgcctatcctcgccaccagctgaaggcaaggccgttctgctacgagcgcctcttaatctctacaaaatgaaaagaaaaaaagggaggattattagcccattactcagaggaatggggaggctgcaaaaatcgtcgatgggcagaggtgaagatgtctttctcggactgcactttccggtgtcctgtaactagagttcagttgtgggacttgttgaagaaatttgattttcttgcctcggcgagatttcaaaaaccagaaatagaaattctcagagtcagagaggaaatacaattaaacagcacgtgggcattttccccctcatttctctccccttaaataacactgctttgagtttccactgggtaaagagagaaagtttgagttttcacggatgttacgtggaggttagaaatggcttaaaatgtagatctctaatcagttttcttcgtggctgaagaggctaaccctttccataaaatgagtccatctgtcgactgttagctatttcaaagtgaagggatttagcactcaaaacaaattgagcaagtttgtttgcctgtttttactgctaactcaaatgaattcaaaacacggagtaattcaagaaaacacataacatgttccagacagcccccaaaagtagggaaagcccagcacctatatagtgactagggttagttttaagcgccaagcttttttaaacgtatctattttatgcacattctcccgagtcactatatatttctaaaattgcgagtattggtatattgatttaggaagagcaatacaacttttagagggaactttattctcaattagggaccaaagagatgtctttttaatagcgggcctgagttttgctctcaagcaggaattaatattggtgggaaaatccgaatccaggagcaatggctgtgttccggcactttccaaaaacatacattaacaggatgcccttgagattgaaaaaacattgtcccatatgcctggcagaagccttcacacctggtcctccaggcgaattatatttatagtccttccactcagaggcaggacagagccaaaatattctgctcactaccaaaatacacatctttgctcaagtcaagaaatcagaaaatcagggttcagaagtaaggcacacttttcgagtgagaatatgccctgtaatttcacatactctttgctttgcaggagcaaatgtggacttgagggaaactctctcccccacccccacttctatcccgtgcaatttaataccatcctcgccaggaaccttaacctcgtcattttaaaaaatgagatatccgtgacccagggtgaacttgttgaatgtaggtacagcagaggaaattctagactctatgagcgtctgagccttgtccagtgcaaacccttcgtgaacactgggtcagtgcgtggccgtgcccacctgtgcgccgacactctcagcatgcctggtccacccgccttgacctcgggcgcggtgtcccagctaagctgggcccagcgtcccggccttccccagctgacaagcctagctcgttcgctcccggctgtggccctcccaccctctcccactagctcactccattcttctagatttctcttcactcatcctctcccatccccaccgcgcccacctccactcccgccctctaccggtctctcactttcctccctccgcagtccctctttgctgtgacctctttcctcaactctgcaggcctgaaagaaggtcacacacgcacgctcacacccacactccacacgcctcgtcccaaacaaccccatgaacattgtcctttgttccgtctcttgggccactttccctgtcgcttcctcccagcccgtcctgatttgctccccaaaagtacgtttctgtctccccgctgccctggcgctccccctttgatttattagggctgccgggttggcgcagattgctttttcttctcttccatcccatcctcccttctggtcctcctttccacagtgggagtccgtgctcctgctcctcggttggctcctaagtgccccgccaggtcccctctcctttcgctctcccggctccggctcccgactcttcggcccgctggcatctgcttccctcccctgcctcgtttctcgtcgcccctgctcgctccccccggcgctcgcccgggcgctgtgctcgctcctggatcgccagccgcgcagcgggctcgccggcgcccgcgcgccactgtgcagtggagtttggtggaatctctgctgacgtcacgtcactccccacacggagtaggagcagagggaagagagagggatgagagggagggagaggagagagagtgcgagaccgagcgagaaagctggagaggagcagaaagaaactgccagtggcggctagatttcggaggccccagtgcacccgtggactccttcggaacttggcaccctcaggagccctgcagtcctctcaggcccggctttcgggcgcttgccgtgcagccggaggctcggctcgctggaaatcgccccgggaagcagtgggacgcggagacagcagctctctcccggtagccggtaagtggaggccatctatcccgcagggatgtgagataatgcgagtctggaaatttgttccacttcggagaatcttcaccgtaggtgatttgtggcttttggggctaagtttcgcccaaggtaacgcagtcggcaaacagaccttgcaaagccctgttcctttcgtcccccgccacagacactaacaatctacagggtgctgaagtcgagagggaagccagaccgtggctggcatttaaaacgaggtatcttcccttaaatctcggtgccaacactgcaggaacaaatcctcgggccaaggattagcattctcaagataaagggctgggtacaaagtttcagctactggaagattagcccccttcccattgttatccattgggaaaaaaaagaaaagaaaaagattccatcttaactggcagttagtgacctctcaggcccaagcgaattacctgggagccaggcctggatgccaagctctcaccatttctttggattgtaactcctttaaattgatcaccagtcaactccaatctggcacttcaggagatacactttaaatggatgcagagaattattttccagctggagattaagaaaaaaattttcgattctaaacctccgaaatatgttcctcttttccagtttaaccactttactttcttaagcaatttagaaatcaaactatcataaggtggtgtgatttttttttactcttttgtgtgagtattgtcttactaaactaaacggaaaaaacttttaccattataaatgtaaatatcagaattcatacattctaaaatatttttatgaaaaattaatctgatttaaagaaatttccttgcatttgttttagtctatcaatcaaaactaaagatgcttttatcacacaaaatatcattttggcagaaatccatctaaaattcaaataccaataatatcaagaaaacaaagcacataagcaaaataaattgaagatttttgttgatgtaacatgagcatacaacatttcaataaccaaactttccctaaaaaattaaatagccacttcatttgtggaatgttttactttaactcagcaaaattacacttaaattatttaggtgctttgttccttaagttaagcgtgtttgtcttcaaatgttcctaaagcacttatattaattggttgtaaagaacgcatacacatggtaaaatacagaactgaactgagcagtattttaatttccttaaataattacttactacaaattaatttactggctaatttcacaatttagttcatttaaaacacatgttcctgtgctgtttatttttaaactttccattaaagattttgttatggggtaacaaagtgtatgaaaaggggggaaatgtgaaaggatctgggattattcgaactgtatttttcctgcactttcagtcttgcggtagtcatcagaaattattttttagcaaattgttttatttcttagggcttgcctgcctgctttgccatggttcctcgtcctccgttagccgtgtagtgctttttgtgtgctcacaatataaaacccaagttggccaaaacaagagtccttggcatatacattccaactagaacatgaactttgggggtgagaactacctcccatcaggaaaagtctcccatctcaatttgtgagattagccattgaagccagttccgaagtctggcagccaaatttctcacagaagacttgtcttgatagggcaagtttaaggatcagcaggcgggaattggaggtctctttttaaaaaattatcttccccagttatttagactcagttcttctagtaggcctggtcattaaatgaagcataaaaatgcaagtctcaaggctcattttgactgcaaaataaatctccaagtcacaaggacatgtaggagtgagctaaggaacacgccttgaccttcttttcagtccttagagtggagctctatgagttcttgaagatttgttttgtattgctttgtttggtcttcagcactgaagcacggggaagtggggggaagaatgtgtaataattgactgactttacaccaagcaacgcaatctttttcttttgtatatttcattctttaaaaaaaataaataaataaaaactatttgcagttaccatctgcagtgctccggctaccagctaataatgcagccagttcagacatataaaaaaaaaagattatcgaaatgatgatgacatgcaaatttcctccgaaattatcataagtaaacatttgaagtctggactaataaaatcccatctgtgttacttcatatcgagttagtagaaagctgtgataatgaattttgtaatatctcacgaacagacatctcaatcagggactaatcctgtgattttactgcagaatcactaaatctggagccgccaaactgctacttctgggcccacgggcccacaaggatcgaatcggcagagtccccgcccgcgttctcgctagcgggtgggggaaccgcctggccgtccccaccctggatccccacgccacagcgccgggcagcccctcctgtaggcagcgaccttggccagaggctccccagggcccagctcccttcaggagaggccgagacgcagggaaacggtactcaggccagaggcaggcccgcagctccctgccccgcctctgtgcctccgccaacccgacaacgcttgctcccaccccgatccccgcacccgcgcgaagtgggccctccggtcgtcggcgtaccctggttagcgtggagagaggcaggcgctgagatcgaaggggcctagggagccctggaccttcttttcttgtctttaaagcaaccgcggctcttctacccacccggtggagcccctcgagacccacctctcccggcttgcctgtggcagagaagggggagcgcgttaaatgcttggctcgctgcgttgtggttgaaaacgtgaaaaagatttggctcgcccgggagagaaagggggagaactgggtagcagttataccagagctatttctccgtccttggcgggcagtaaaccctccaagaacgtttgccctgctctcctcagtctcgctcagtccacccagtgtctctcctctgcgatcttaaatcatactttagggtaattatttgtagtaagtaaataaatggccgggttagtatctctaggagaaagtgtggctaaatatggaaaagtggctcctgatggatgagaggcccgaactcagctcgctcctgaaacaccctaggccaagagcccgttcgtttcagaattacagaaaaccgagggaaactgctgtctaggacaggggcacgttggcgctgatgttctacaaatgtttaccgagctccaactaatggacaagcactgaagggtggtctttgcatacagcttcccaaagagaaaagtcctctccacccacccactcccgctgccattgcgttcagatgagttcttaaccccggcaccgagattcttgaaagtaggtccacagcctccccagcacactgtggctttatagtcctctaacctctgggcacttttgcggcaactctggagggagatcccctcttgataaataaatgtcctgggcccgaggctaggctggagatgctgctgcacatgccagaggctgtcaggtcggaaaaacacgcctgaagcctagcacacagtaggcgcctaacagctagtgtaacgtagtctcatctgagccctgctcactcgacggccgccgcttcttacagccttccttctcttctgttttgcaga

SEQ ID NO: 5 - DNA, 9001 bp, Homo sapiens
agctgatggacttgctaaatttctttcttcttttttctttttcatattatttgctagccataatggaatcctctaggtttaagccaaagaaaaattggagagacaaaattagattttgtagcccttttcccccccgggaatgcctttttttttctttttagtttctgatgaatggctatcatttatttctaccaaatttaaataaggactgctgccttgtatgtttaactaggcaggcagagggaactggtttgtttaggaagcagtgactgagatgtcctggccaagttagtgacagaggaggggagaaagaatccagaccaatttgtatgcagtatattttactcccatgaaataaaacacatttgtttcatatttgctgaaaagtaaaacaataatattgtacgaaatgttatacacagggtaggttgtacatagcagtttcagaaacatcattgcatccaccagagaaactattctaaaactgatattcacacattttttataataataataatatgttagaaacatacagtgtggcatttagtatatacactcccttgctcgcaagcgaaaaatcctaatcgcttctgtataacatgctttattttaaagcctaacctttaaaaacactgttgtgatattactaacaactgcttttataaaattaatttgacatttcgatatatatacatcctttcagtcatttaaatgttaacaatgctaaacttaaaaaataacaagcttatagtaatgttaaaatgtcatatccagtcaaacatttgtttgtgtatgtgtccttgcaactgttagaaatacttgtagtgaaagatgtcagacactgaggacatccctttgaaatcaaaggagctctctctttgattcagtggtttccttttctctatatagcttctctttctctccctttctttagtgcccacgaccttctagcataattcccagtctttcaagggcggagttgccccatccggcaaggtcctaggatcccggcgctgtgggtgcggctcacacgggccggtccactgcatactggcaagcactcaggttggaggccgggttctgcacgctggcgtagccgaagctggagtgctgctttgctttcagtctcaggctggccaggctcgagttacacgtgtccctataaacatacggaggagtcggcggcgcgtaaggacaggcaggcgtcggcaccgcggaattcagcgacgggctactcaggttgttcaagttattcaggctgttgagactggagcccgggacgcctgtcactgctgagggcaccatgctggacgacatgctcatggacgagatagagttgggtggggaaaacatgctctgtgatgacagggggttgacgttcatagagttgaagaaggggaagctcttggtggatagggaggcggatgtaaggcccttggcggcccagttgttgtaggaatagcctgggtacatgtcgtcgtagggctgcatgagcccattgaactgcggcccgaagccattcttgcatagctcggcctgctggttgcgctccctctttctccatttggcccgacgattcttgaaccaaacctgggggcggttggggcaagggagcaaacagatgccacagtgcagattactaaaacttccatcggaggccaacccccgccttcccccgacacacacgctagcgcactcacacaccctggcctcgcttcactgcaccgccctgcacaccaagataccagggccagctttcagttactggcccgggtctccaccaagcgcaggagacctggtctgctctggcctgcgagctgggactcggagctacgccacaaacctcagccgaacgcatggagacctgcggacggtttgatcactcagccaggcgtttctccaggtccaaaaacacttaatgtaaaacaaacgcggggcagcaggcttttccaacccttcccggggcaccttgcaaacttgcttccattccaaagccacagacccacggatgaggagaaggggctggaagggcactagaggatcgctctttctcccacgcaattcctcccttccttccctgacctccactgtcgtcccccaccccctggtacgtgctcccttaacagggactaggccgccaacactctttctcgcctagcaaaacaaccaaataaagagcaaaagaccacctcttcgtcagctcgttaactccaggagcttggcatattaaactccgggaacccggaaagggtagttttggagattcccccttctttcgctctgcctcttctttaccctaagcccaccacaggcctgtccgcgcgccaggcccagccgggtcgtttggctttgcaggcggccacccaggccggccggcttccacccgtgtccggtggcccagccgcaaccccgatcccaatccacatcgggcctccctgtcgccccagacggcggcttttgtgtattggagagaggcctggcctgagatatccgagctgacaccagtgatgtttcacattacacatctccgccgggcccagccgtgtaatccgctttttctctttttcctttcattcttgatttcctttttatcccccttcctctttgcacccgactgctataaaaagcacgcctcactcccacttggctcgacaagcagccgccctggaaggagaggcagctgcaaggagagcccagcgccgcggctacaaagcactagggtggagctgcggaatagcgggcggggtgggagggcgttttcgaaggatcccagaaaacccatagactctgtctttaattacttgccatttctaccctaggccatctaaactttgctcaggcgagaagagtacgtgagaggcccgttcccttgatgtgcaagagagctaatgaaagactgaccttgctcaaaaccacgccgcccaggacccagctctggctctggacagttaaactaaaaccattttcaacttcttcccggccttttatccaccagcatagcctcatgccttgcacaaatgccacccagagagtgtcttcattccctctgatttgggagagcattttggtctttattctttttatcgttgttttcttctttttgtttgctctgctctaaccgggggctttattttttctacccagagcacttaattttttttttttaacagcaaagcctctggatgccgcttgatttgcttgattctgttttctgcttccagaatcctaacaaatttggaatcttccaccgaccagcataaaccaggacgttgctattgggttatttatttgagctcatttttgccaatccataaagtacagatttgctacaaagttaaggtaagccctttttacaaaactatgattataatttagaagagggggtgtgagtttcaatttccagagttcaactcctgagagaagataaataaaccaagcagaaaagtctttcttctttttttctttctccttctaagaggactagtagttgtgtattaaaactttgctcccggagatcacaaaactaggaaatagggtgtgtgggagagacctgaatggccgaaacaaccgtaaagaaggtgtaagaagcgcgagcccaggagggaaaaagctgggccagggccgggacaaaggtttcccagggagggccaactcttccgtgtctctggcgggttttccttgttaaaggctcacaggttggagcctgttcgcggctcttggcctggtagggattttattagctctgctctggcaactgcaagccaggaacacaatgtcctgtgcaggggattgcccatgcagcccagctcgtgagatcgcgggatggcggggcagtgagccggtgccgctctgggagcctgagccagggcggcagtcctgtcggcctcggagagggaactgtaatctcgcaaccaggccgccgcgaggccttctgcctttgcaaagctgcgccccaccggcgccctcccaggcggcgctgccttccacattctctcctggtctacttggcctgtacctccacaacatcctccccccatccctcccagactccgtgctggctcctacccggactcgggcttccgtaaggttggtccacacagcgatttcttcgcgtgtggacatgtccgggtagcggttcctctggaaagtggcctccagctcctggagctgctggctggtaaagtgagtccgctgccgcctttgccgcttcttcttagacgggtcctcggcgcccacgtcctcattcttcccctgctggcttttatctttctctgaaaacgaaacacacacactttcccgtcagcatgcccacctgcaacgcggacgccaactggaccggcggcagaagccgtggaagagctgggctgcctggcgccggaggagggtgcgcgcggcggctccgggccgcgaggagcgctgcgcctgtggggtgtgcaggcgcaagtgtgggtgtccgcgccccatttcctcccctcccccagcgccgcacgttttatttacatgtttatctcactgcagcggcacattcacttttatagcctgtgctttcaagtatatttatacacctctgcgcagacacaccaaatctcctgggacgcgcacacgcgcgtggtttacagacccccctccccctcgcagaaagctcagatttccatgcggtttgggaaggctaggaaaagatgtggggattcggttgggcaccgaagttcgccggccctttcccaaaaaaaaaaaaaaaatgcctcttcgcgaagggcatttctgagtggtttcaggcaatttcctaacgagtggagctcctcgggagctgaaagccgagaggaaaacagggacagaggtcggcggcctctgaaggtcctcgaatcaagatgctgggatttttgtgacccaggaaacagaagggaggccagggtacgaatagagagggcggcagaattgctcgcgcccttagcgccccaggagccgggccggtcgagggagaactaaagggatgcggggtagtcaaaattccggctcccggaagttctgcggggagccaggcgaacgaccactcccaccacgcctccccccggaggggctgacttccttggggcgagagggagcgggtggcgcagagcagctgagcgggaatgtctgcagggcggcgcggcgccttacctgcggcctccgggctggaggtgtcggagatggtgtgcacctccagcctgtgcttggaggagtccagcgaccggggctgaccgggagccagaaccgaagccatggctaacggctggggatggtgacaggaagatgaggagacggccgacagcttggtccccgctgctcggtgctccaagtgaagcgggcctttcatgcagttcatggacgagggagcgcgacgctctactagtccttggctactgccccgccgagcccccgtagccgccgctgcccgctccgggtcgcgctctaggcgcggagtttccccgctgcggggagagccaggggacgcaacccccgccgagttctcaagccaagctgcccccgtctcctccggaaggctcaagcgaaaaagtccggagacggaaagtcagcgggcaaacgaagacatgggatgtgggcagaagggcaccactcagagcgtctttagggagcaggcttccaagctccaaagcgaaacaagagtgggcaaagacccccttcttctctccctccctcccccaagaacccctccaataaggaaagctaacgccgaccgcgctctgcccgccccccccccacgcggcagccctgacagagaagtgtcaagagtgacagggacaggtaggtgatattagatcccctgcggcggcagcagccgctgcagccacgacgcggccctctgagcgcaccctccgcaacgcgcacacgcacacccctcgggcggtcgaacaggagccgggccttgccgcagctcagctccaggcacccaggcgagcgacggaccagatctgcggctccgcgcttccctgttggcctaacatcttaaaaccagaggcgggcttcctggtgccgagacgtcactccgccgcggccctccccagccctctccgcctccgcctcctcccagacccttctccgggtgcgactgacgtggctccgcaccaatcaggacgccccgagccgcggtggagggactgtcctgcctgcacctatcagcagtgcggggccgggctactgcctcgccgtgcgcactgggtctacacaggcaagctcccgggaattcagctcctgcccagcccaaggcgatccggcttttagtacgaacccaaaggtgaagagatgaggctaggagtcgaaggcttgggagaagagagtggaatggtcaagaagagaaaggtacaaggatcaacaagacacccactctttgtgtctcactacatccatttccaatcccccaccccatataaaaaggagacacgttacttaaaactagaaaatttgaaaaacagcaacaaatcacctctccgatcttaaattttccaaacagcctgtcaagtgaatgctgcgctaatctgaagaagctttaattgcaaagaagacagagccctgaaaaggcaggctaataaattagaaatcgagaagcaaatggacccgtcaaaagaaaattaccttgactttaaacgaacaactgtttggtggttcactctggatttatacaagaataaaaagtcgcctcagatcacgttctctgtgatgcttattagtccccagacagaaaacacacaatagaagagaaaccctaacccagcgttttcaaaatgctgaaagcttatccattctacttaacgttgattaagacacatatcctagatctttcaaattccttgtacactgtattaagctcgtcctaacccgagagagccacgctttaaattcgactctcttgtttactttattatcaatcagatttaaatccataaagcctgtagaatcaacaaccttgagctaattatatatgaaatatgccttaatgaatttccatacaattaagaatgttgccaaataaccaatttcaaggataatttttaacagtcattttcttttcccagtgagctcaaggctgtcttgagccattaaagtccaagcaggcagaaggggtgtgtgtgagctaagggcgaaaagcctagaactgcgctcaactagcaaaagcaaaaccttatttatataaaacaaaaaaaatcacctttggagacatcaactctttatagcactgtttccaagcaaatttaatttccaaagaaattaaagaaagaaatccaaacatattcaaaataatttttgaaagtccttttgtcccccagcataggtcagctggagaggacaaactaatctcctctgggtttctgcatgggcgattgttttactatggagttagtgttatcatctctgaatgtgtatttgtttgacattacagtcaatgatttgcaatgccagcatgaagtatctttaaaacactccctccttgtccttgttcacaagattgggaaacttattcgatgtggaacaaagtggatgaagcagactacaaatatatttgcaacttatgtgtctctcctttgccctgaccacccccaaaccctatctgcaactcctccccattttaaacttgcagtccaaagacgcacatgagaattgtttttcagtctttcttcaccagtatcatcccactttaagaataatttagctgcaagggaggaatttcttcatagtaagctttaaatcagcatttctgcttttaaccttttattccactttaccccattccacacatacagacacctgctcagagtaaaacacatcctcatgtgacaggtctgcattagctgaggctcatacatccagctatattaggtcctgcaatcttatcactaaattatacacattacactagcagcctgttggtaaagaaggttaaattaatttacattctgctcattatctggtgcttaaatgacgcattttatcccggagatttggcggagaatctccttctcagaccccacagcgtttcactgaagacaatgctcttacatttgtagtggtttttaatctgataagactctaatttgcttaagtcttttaaataagggttttaaatgtttctagccgttttcttattgaatttcctctaattcccccaagatcataaagtatatgtgtaaagtaaatatttcctcccattgcactgccagccgatgacctataactaagtcaataagaatccagctcttttctgctgaatgtgtttactaatcatattccagtttcttcttttaaacctcagaatagctgtggtccccacaataccatgccccttaaagcttcatttcatgaagggactccatcacattaaagaatgaaaaaaatctccactgtagttagtatacacagcccctcactccttgtttttcaagattcaaaccccagagctgcaaatatttttggaagcttgggtgttaatgccttattttagaaagccgagaagccccacagagccatatagatttctaaacccatctctcataaacccacagaattttgataaaagctctggtggctccactctaccgatggaactttcatcacgacaaatatacatgtatgaaggacctcaatcagcctccaaagtggttgaaaaacccaagggcacgtgactgctcctcatagtgccaacgtgtgcgagatgttggaagcactggggatcagcagcagcctagatgcctaaaaagataaggtgtcctaatttgtgtggacccattgaagtcaagtggtgaataaagacaattatctagataattcagattaaagtaaaagcaaaaccatatctatttgtatatatatattcacatccattttatattacagacacacacacgcacacacacactggctctgtaaacaactgactcaaagtgaggattttctttgcatttttccagcaggagtttcaacattctcctaatctcctaatcactttaca

SEQ ID NO: 6 - DNA, 1920 bp, Homo sapiens
ccaggctgccgtagacacagcctttgctctcccgaaaaacacgttctaggcgccgggattccagatacctgggaaatagagtgcacgcagctgttgagaggcctcgcgcttggcttctcctatcactgaggcgcagaggtgctgtggacagcccagacccacacggcgcccgaggtgaaacagaaccctcagtctccctatgaggccactggcactctcggctgtccccagagctctccgacttagagctgaatgcaaagtaagcgctcgaaatgcagaagtagccggggccgcccacggcacctgcctcgctcggggcgagagaagacgccaggctgaggtcccagcgacctcaggcaccagctccgaaggagggcggggagaccgcaaaggggaagtgcccggagggccaacggcccccgcgcaccctgcgcccctctgaagcgcgccgcctccccgcgccggggactgggacctgcctctggggaatccgcctagaagacggcggcggactggggtcgggcactctccagggctgtcaggccctccccagccctgcacctgccgcgccgccccacctcgccaggaagtctcagagaccccggggatggggtgggagcgccttcccatcgcgggctcaaaaagaaggaaggacgcccccaggggtcgtagaaggaggactagctccaagccacaactttcttcggacccaaggcaggccggctggggctccgcgcctacacggcccctggcgggggtccgcgcgccccgggagccccgcggctcggggaggaaagaggagacaagagacaggcgaggattacggggctgacccagccggggtagggaccatcgtggaaaaactttggcgaggtggggggacgcggaaagagagcggcccgcgccctgcaccttgcgccgggcatcccgcgccagtgcctcgctcccagtgccccgcgccccgcgccccgcgccttgccttcaccccgggccagctgcatcgcgcccgcgccgcaggaaccgtggagttggaaagtgggggcgccgcggctggggggctgcttcagctgcgcctcggccagcgatcggcgggccgggctcaaatccagccaggctgggcaggcggtggccgcgcgactggggaccgggcgccccgccctcctcgctcccctcctccttcctctccctccctccagccccttggcctttttcagcccctaccggatctgctcgtccgctgtcctctcttttctctcgctcttcatatcactctccaccccttcgccttgccttcgcctttcttcctccccttgtctcctgccccctcctcttctcccctcccctctaggggcggagcttctcccctccctcccagacaatgctgtggctgcgtccccttccccgccagctcgtccaggctcccgccgccagcgattcttccgggctgggggtggggaggtggggggggagtgcagggttggggaggatgagctggctcccctcacctccttgctgctgccctctccaagagggatggagacttggcccaagctcctcggttcacccggagctgtgacagccactcccagggaacagtcacgctgccctaccaagcccacctccagcggcctggattccccaggcagaggttgtgggattttgttttttctaacatcccagcttattcccaaaagggtttgagccggacaggggctaaacaggccccttcgacttggcgggccggccagacgtgacagcaatgccaaggaggccaagtttctttgtccatttctcacctcccccttttccatccctggacctcctggcgcccccagtacacagaggcccttgagcagcccggctgcaggttccctatctactcagagttctccccctcacgtgcctatccccaaccctgca

SEQ ID NO: 7 - DNA, 5473 bp, Homo sapiens
gtaatgttaattagcttcatcttaaagaaaaaccaaacaccagagcaaataatgactcctttgcggagaaggagttgtaagggttggggagaggtaattagtgtcataaaagcctcactacaaagaagtttagaatttctctgttctgctgtgcagcagagtgaaacacagtagcagaataattgtgcaccattatcatgataatctaatttgcttctttagaaaaagccactgtttgcagttaggatagtaggaaaacatctagaaaataactaaaatgtaaataaaagtatgaaacaacaataaagttcacttcttaagagaaaaaaagaagagcactcagcgaaaggagaatgaagtatatataaagcaagtaactcttaggtactttgttctcctggatgttacctgcttaaacttgacaacttttacaggcagtatgacagattttttaaaattcaaataaagcttgcttttgtattccactttcaataataaagcatattgattgactcacaaattaaagtttttaaaaccccattaaagtaaaaatactgcttcagagctttcattggtatgtttttgaaagcaagtgtcatagtcaatgtaaatcttcaaaaatttctctgctatttagtacaacagagggtggattttgtgccagggtggcatcctttgtgtaattcacatggcctgaggcttcttgcctttttttcccctagaagagttggaattaagatactaataatcataactgtaataattatcatcatgtttttaaggggttgctgagcctctggagatctcagtgcacagagcgaagcaggagaggcttaaaaaggaaggctctgctgctgatgctgtgatgaccaaggcagcctattattacttttcctcttcaacgtgactgctctgtttttttttttcctgatcctgttacaagatgtggggaagccccttaagaattgtgcatagttcgctacagatggtggtctctgtgcccagagaccgaaagagtatctgttacagcgatactttgtaacagctgcagatgtgcgggcctaaaactgctccatgtgttcaaaccaataataactatcattttattctattttattatctgagcggaaatacaatctgaaacatttaaatttgttccccctaaagctagaaggatatgtgtatgtgaatgtacacaatttgctcctttaaatgcccccaaagcctatttttgctattacatttgcctccacaaccaataaagaaaatctgtttcagtcctaacttcattgggtatggcacgtgctggagggcaggctttggaaatataaatactaatatatgtggtttgttttaaaatctaatgtatttagggtcagtttcgttgccttggttaaatgaatgaacaaagagtgaccaaaatgcgtttatttctccgctatttcacacacagtttgagatcgaccgctaacagcagactgtaaatttctgcacttaacagttactaattttctttatagtctgcacatctataaacctaattgggatatccgcttgacaaacctagaccctgcagagcagactttcaaggaaatccaactccagagaacaaaatactctttggaacttttaaggcatccagagataaaacgttttctgtgggatttttttttaagccttataaaagtaggcccattaggattaaaccacattaaagccagtgcgaggcaaggggggtgtggtttatagaaactctgggagaaagcccagcacagctttcttcttctgggaacatatgttaggatggaaaaaaaaaaaaggaggggagtgctataggactaagatctactttggaaaataagacctctagtaaagatatctctttccttctcatcttacaccagacactagaagcaccacctcccgagtgtgtcccccaagcctctttccaaccccaggctctctctgctccctgggccctcgacctcctggcagctgggtacctgcactcgggcctccgacaggcccagtcgctggctcagttcctctcgcatgaaggcgtcgggatagtgggtctcgtcaaaaagcctctccagctcattgagttgttccagggtgaaattggtccgacttcgcctctgcttgattttggtctggccttcgtcctccatccctttcgcatcctctttgcgatctttcagctccggggacactggagggggcaccccagcggggccacacgtgcatccacacgaacacacacacacacgcacacacacacggacgaaaacagcacagcaaatcctgttaccagatttgtcgcaaaaaagaatagagaatccttccccctcgtggaatcctggtccggcttctcaacccacccggaggaagaatatcccggagaagcgcaaaggtcaagtctgagcggccgcctggggcaaggtgggcagtcatccaccacctccttcacaaacgtacctcgactcaccgcctcactattcaccccccagtcaccggccttccccagcaaacaccaaatggtttccactcactttcgcactcacttgctccgcagcactcacagaaatcaaaggcgcagcgccaggcctctcacagagcaaagtctggacataagggcgcggcaaggccacccactggcctctcacaccggccattcccagaaggctggctcgttctcaggccagctctcaccaccgctggctctctgcctaccgcaaacttgctggtctaatttaggaacaattgggccgaaaggtatcagcgagagcaacagaccccggtgttgtgccgcacagggagccgcatccgcagacgcccctcgctgcccctgggctcgggccaaaccctgcataaggtcccctggacagccaggtaatctccgtcccgcctgcccgaccggggtcgcacgagcacaggcgcccacgccatgttggctgcccaaagggctcgccgcccaagccgggccagaaggcaggaggcggaaaaccagcctccggtggcgggcgaaagcaaccgctctttctgttctctcttcgccctccctcgtggaaacgcagactcgaccctaaacgcttaacccacagagatcaacaggttcaagcggaatattcgcgatcctcggtttctattggttgctcaaagccttttcatgcaaccagcagctcggatgtttaataaaatatgaatttttctgctctgggtttgcacacatccgttgccactttcctgtccttctcctccctttaaaaacaggagctcttctagtgtgagcatatacagccaccatatatatatccccctggaacctttatcctctgcgcccgaatcagagactccgggttttaagaagtcaaagctgagtttagatagtcgaggctgtttgcagttcttcccagcgcaggatccaggccagcatgggtgttaaaaatcatttccggaagagccggtctgcagagaaattaatacttgccctgagcttggaaatcaacaatcccaggaactgcgcccgccgggggttcagacctgaacctcgccgtcaggcgcgctggcgaacctgtagttcgggcctgtagttgtggactcatggccgggaggctgcactgggcaccttgacggtaactccaccactttacaaatttaggaagacctggtgctggtttggaggaagaagagtcgctagatctcggccctgccgggcattctagctacggtgatcttaaatattgccgtattttctagttctcagagttagttttgtggacatttgtcctttctttaggaaggaacattatagtaaacattatgggccaatttaatagcaaagtatttttactgatattgtattgaaatttaaatatgaaaacacacccttcaaattctgccaatgaggtgggaaggctttgtctattacatgtcatctacacagtggatgccactcaaagttttggggcttcgaggagatgtccaaatttcaagttgatccatagacttaataaaatctctatttttgtccccaaatttccaattactgatctaaacaggaacagaccgtgtcataaacaacttaattgcttgcttaaatatgtgattccacgcatgccacatattttcttaattggaaaaatatggcagtacaccagttactgcaggcaccaagtgccaaatcaattttattgttgaactcctttgaattggtatagaacgctctgccattgagataaagacgtttcctaacactgagctagcaccaaaggatttttgctctaagagaaccgagtactgggtgattgaaaacactaaaggaattgtgtaaatatagatccccacctcccccgccgccccccccccccgcccccaacacaccaagaaaccgaaacgcctcgcccgggagaagcagcgtagcctggacctcagctttcgttggcttccttctaccttgaaagagaatgggaagttttggcccctaagatccaaagattcaggggctctgcggagttcgaggggtcttggcggccccaaacacctaggcgaccggagggttaagctttccacctctgccccttctccctcccggcaaactctgcgctagaggctagctttagtcccgccgtctggttcagcaccccctcctgcagcccggccccgcgaacttccacgtccgcctgcgggccatccgggctgcgggcccatcctcccgctggtgaaaaatgcatttcggtggaatgggaacatctgggaagggcgcgcacaaaccccacacgcttccccccacgccacccccacaacacactaggaccccacccatgaccgagcataccaccggacccccacccttccactatcactctagctgacaaagctggggtccagggccctctccgtgtccctctcccctccccgctgggcctcggagtcctctcccgcccgagaggagtccggaaggcgggaaggggaaccgctgccgggggtcagtcaggtcgttaccctccgtcagtcgcgggctgcccggctccctgcttctctcggcggcgcccatgtccagctcccggacgggagagcgccctcctccagctcctccgcctgctcctcctcctcctacacctcctccgcctcctccgccgccgcctccgcctcctccgccgccgcctccgccggccgcccggactgccgggctgctgcggtcgtcgcggcccgcctcggtgcagccggtcggctccttggccccgcgcagcggcccgctctccagcacctcccggtacgtgatcgcctccttcttctccttcactttctggtcaaaagacttggagacgaacgccgtaagttcttccatcgccgccgcacgtcagcccggcgctcaacctctgccagcagagccccgctctttttttccttcttctttttttactgctccagcccccccaataataacacatcaatgggacaggaggtgggg

SEQ ID NO: 8 - DNA, 1405 bp, Artificial Sequence; identical to SEQ ID NO: 1
  Artificially methylated Sepin9 A at Cp[AT]

SEQ ID NO: 9 - DNA, 2365 bp, Artificial Sequence; identical to SEQ ID NO: 2
  Artificially methylated Q9HC74 at Cp[AT]

SEQ ID NO: 10 - DNA, 4261 bp, Artificial Sequence; identical to SEQ ID NO: 3
  Artificially methylated GSTPi at Cp[AT]

SEQ ID NO: 11 - DNA, 6343 bp, Artificial Sequence; identical to SEQ ID NO: 4
  Artificially Methylated PITX2 A at Cp[AT]

SEQ ID NO: 12 - DNA, 9001 bp, Artificial Sequence; identical to SEQ ID NO: 5
  Artificially methylated PITX2 B at Cp[AT]

SEQ ID NO: 13 - DNA, 1920 bp, Artificial Sequence; identical to SEQ ID NO: 6
  Artificially methylated RASSF2A at Cp[AT]

SEQ ID NO: 14 - DNA, 5473 bp, Artificial Sequence; identical to SEQ ID NO: 7
  Artificially methylated SHOX2 at Cp[AT]

SEQ ID NO: 15 - DNA, 1405 bp, Artificial Sequence; identical to SEQ ID NO: 1
  Artificially methylated Septin9 A at ggcC, agCt, Ccgg

SEQ ID NO: 16 - DNA, 2365 bp, Artificial Sequence
  Artificially methylated Q9HC74 at ggcC, agCt, Ccgg
gtggttgtggtgggggtgttagctgtaggggtgtttttggtgggtgggagttggtggtcttttgttggtgttatgggatttgtatgtttgttttgtgttttttggtttttgagtttataggccgggattttgtttgttagttgtgtgtgttgttgtttaatttttgtaggtgtagagtgtgtggtggtggtgatagagaattttgtttggttgtttaaatatagttttttgtagaaggattttgtgtctggggaaggggaggaatttttttttttttgggtgtttgttttttttgttatggtctggtctttatatttgtttatatttggtcgtagtggggtgtctggggggaggggttgaggtcgtgttttttgttgttttttgggtgtgggtcaggtggggaggaggggggtgttctggttgtgtgtttaggattgttttttagtggtcatttgggtcttagttttttaggtctggtcttgataggtgggtggagtagttagtgtgagatagggaggccggtgtgggtgtgggaatttgatttgtctgggaggtgggggtggggtgggggtgtagtgtgtggggaggggccggtgtttgttttttttttttatttatttagctgagttagggggtctaggggtttttctggtggttagctttgtattgtaggagtgtgggtgtggtgttttagttagtgtgtagggtctgggtcttgctgggggtgtttttttgttgttgttttttgtgtgatttgttgtttattagttattatgttggattttgtggttaatgtgtagctggatgggattattttggattttgaaggtgggtgttgggttggttgttgtggtcgtggatgtgttggagaggattttgtgggtgggtctggtgtgggatgggggtgtgttgaggggagatgggagtgtgttgaggggagatgggatttttaatttaggtgtttttttgttgagagtgttgtgtgtttctggtcttgtgtttgtgttgtttatgtgggggattttgttaggggtatttgtgtagattttgtgtgtttttataggattttgtgtttgttttgtgtattgttgtttgggtttttttttttttattgttgtttgtgtttgttaagtgatagtgatttttttgagggtttgtgaggttgttttggaattttttaggatgtatagttttattttgggaaatttattggttttttttttttggttttttctggtggtttttgggtcttgtttggatctggtaatgggatagggaggttgttttttatttttgattgagtggatagttgtgttttgtttgggtggatagttttttttttttttatgttagttttggggtcgttaagttgtgtagtttgtgggccgggagtattgaatggatatagtttaggttgtggtagggtttagagtgggatgttttatggtctttatttaggtctggggatatttttatttgttttttagaattgggtcgtgggggatagaaggggtctgtgtgtgggtagggagagtattttggtttttttttgtttttggggtttataaagtgtgttgggatttgtggggttgttttgtttaagtttgggtttggtgtttgtgtttttgagtttgtgagtgtgtgtgtttttttgtgtttttttgattgctggtgttggggttttgtgttttgtgtttgtgggagtaaatatagtaggtgaaggggaagcttatataatggtttttagtgttttggggtagggtttttgaggggtgggtctgtttttgctgggatttggagtttttgttttttggagaggtttttaggttgatttgggtagagttttttggtgggccgggagggggaaaggttgtgttgaaatgagtaaattgtttaggtgttaggtcaagctgggaggtgattagtttgaggttttttttgttttatggtcagaattagggttgatatttgggtgttttgagtttagctgtttatatggtctatttggggttagttttatttgagtgggggaggtggggtcttttgggggattagaattttggttggatgttaagtagagtgttagtggttgttttttagggttgggtctgaggagggtgtggggtggtgaagggatgggagggggttgtgatttagtggtcattggtgttgtgtagagtgtgagctggaaatattgtagttattttgttagcttagtggtgaaagtttttttttaggttttatttttttgtatttttgttttttagagggaggggaggtttgggtttgtagagctgggagggtttgttgtttttgttttttttttttataatatttttttatttggatatttttgggtatatgt

SEQ ID NO: 17 - DNA, 4261 bp, Artificial Sequence; identical to SEQ ID NO: 3
  Artificially methylated GSTPi at ggcC, agCt, Ccgg

SEQ ID NO: 18 - DNA, 6343 bp, Artificial Sequence; identical to SEQ ID NO: 4
  Artificially methylated PITX2 at ggcC, agCt, Ccgg

SEQ ID NO: 19 - DNA, 9001 bp, Artificial Sequence; identical to SEQ ID NO: 5
  Artificially treated PITX2 B at ggcC, agCt, Ccgg

SEQ ID NO: 20 - DNA, 1920 bp, Artificial Sequence; identical to SEQ ID NO: 6
  Artificially methylated RASSF2A at ggcC, agCt, Ccgg

SEQ ID NO: 21 - DNA, 5473 bp, Artificial Sequence; identical to SEQ ID NO: 7
  Artificially methyalted SHOX2 at ggcC, agCt, Ccgg

SEQ ID NO: 22 - DNA, 1405 bp, Artificial Sequence
  Artificially methylated Septin 9 reverse complement at Cp[AT]
gcgggcggcgtcctgagcgcaaaacgtgaacccgagtcgccaagtttgggcgctgctggacggtcccatctggaggccgtcccgtgccccactaagtagaggagaaaccgaagagaatccgaagaaaggatgctgcggcctggaccaccagccctagaggctgaacccaaggacacccctccacctagccccgaccccattcacccacacagacgcacagggacccaaagcacccggccgacctggaaagtcagcgattcctgcgagggtgcaaggggcgaggaagagggagcgtcccccagggcagcccctccgacactcgagcaagggctggagacagcgcaggggacggtcggctcaggtcgaaagcggcccgacagcggccctgtcctgggaggaactcgacctgcagtgtgcccgccgcggggactcgctcagctccgggggcgcctcgccactcccggccgcaggcactcaggtgagcagcgctggtcccgggacaccgacccctccccaccccgggcgcgaagcccacctgagtaagacttcttcatggtgcctccgtggccgccgctcccaggaaagtgtggcggcgaggcagcggggcgcgcgctcccagggcgctaatcctgggccggtagtaggaaggcgggaagagggggcggcccgccgtctggagtgcaccgaccgggccccgccccggccccgcccccgccccgcccctccccggagatgcgcatagaaccccggcccagccggctgtggtcccgcccctgacccgccccctccccgccccgtgaacgtgcgcgccgagccccacccccgcccacccctgcgctgcgctgcacctggcggagcggggctggcgggcgccgggcctgggagggggcgcccccgcgcggcagcgcagaccagaccagaccaggccaggccgggggtgggggccgcctgcgtggcccgccgcgcccgcagctctgcacccccagctccccgcgctggcgccaatggctggttccgggagtcgccgcacttcccagtcccgagtccgggcggggcgggcccggccaggtggaagcgggcggaggtgcgggcgctccgggcggccccgccgggcgaggcggcggcgccgggcaccgcggcggcgccgggcacagccgggggtcggagccggggtgccggcttagtgggccggggtagggcgggacaggacacctgtcctgctacttttctggtaatcaaaagggcagagtgcgtcgattgagttggagccttagtttcctcacctgtaaatgggcgcgttggacagatgatcatttgttctccctgcgctgggcaccgtgcgcagctcggtgtatcggtgcagcggggcagacacagggagccgccctttacaactcgggtaacg

SEQ ID NO: 23 - DNA, 2365 bp, Artificial Sequence
  Artificially methylated Q9HC74 reverse strand at Cp[AT]
gcatgtgcccaaagatgtccagatgaggaggtgttgtgggggaggggggcgggaacagcaagccctcccagctctgcagacccagacctcccctccctctgggaagcagggatgcaaagggatagagcctgaaaaagggctttcaccactaagctgacaaagtaactacgatgtttccagctcacactctgcacagcgccagtggccactggatcacaaccccctcccgtcccttcgccgccccacaccctcctcaggcccagccctgaagaacagccactggcactctgcttggcgtccagccaaagttctggtcccccaggaggccccgcctcccccactcagatagggctgaccccaggtgggccgtgtgggcagctgggctcaggacacccagatgtcagccctggttctggccatggagcggggaggacctcaggctggtcacctcccagcttggcctgacacctggacagtttgctcatttcaacacagcctttccccctcccggcccaccagagggctctgcccaagtcagcctaggagcctctccgaggggcgggggctccaggtcccggcagaggcaggcccgcccctcagaagccctgccccagagcgctggagaccattgtgtgagcttccccttcgcctgctgtatttactcccgcggacgcaggacgcagagccccagcaccggcagtcaagaggacgcaggaaagcgcacgcactcacaggctcagagacgcggacgccagacccaggcttggacagagcagccccgcaagtcccaacacactttgtaaaccccgaagacaggagagagccaaaatactctccctgcccgcacgcaggccccttctgtcccccacggcccgattctgggaggcggatgaggatatccccaggcctggatgggggccatgggacatcccactctagaccctgccacgacctgggctgtgtccgttcggtgctcccggcccacgggctgcacaacttggcggccccgaaactggcgtgggggaggggagggctgtccacccgagcaggacgcggctgtccactcagtcggaggtgaggaacgacctccctatcccgttgccgggtccaagcggggcccgagagccgccggggagagccaaagggaggggaccgatggatttcccagagtgaaactgtgcgtcctggagagttccgaggcagcctcgcgagccctcgaggaggtcgctgtcgcttggcaaacacaaacaacaataaaaggaaggaaacccaggcggcagtgcgcagaacgagcacagggtcctgtgagggcgcgcagggtctacgcgggtgcccctaacagggtcccccacgtaggcggcgcgggcacggggccgggggcgcgcggcgctctcagcgggagggcgcctggattaggggtcccgtctcccctcagcgcactcccgtctcccctcagcgcacccccgtcccgcgccaggcccacccgcagggtcctctccagcacgtccgcggccgcagcagccagcccagcacccaccttcgaagtccgaaatgatcccatccagctgcgcgttgaccgcggggtccgacatgatggctggtgggcagcgggtcgcgcggagggcagcggcgaggaagcgcccccggcggggcccgggccctgcgcgctggctggggcgccgcgcccgcgctcctgcagtgcagagctagccgccggaggagcccctaggccccctggctcagctgaatgaatgggggaggaaggcgggcgccggcccctccccgcgcgctgcgcccccgccccgcccccgcctcccgggcggatcaggttcccgcacccgcaccggcctccctgtctcgcactggctgctccgcccgcctgtcaaggccaggcctggggggctggggcccgagtggccgctgggggacagtcctgggcacacgaccggagcgcccccctcctccccgcctggcccgcgcccaggggacggcgagagacgcggcctcagcccctccccccgggcgccccgctgcggccagatgtgggcggatgtggaggccgggccatggcgaggagggcgggcgcccagaggggaagagattcctccccttccccgggcgcagggtccttctgcaggaggctgtatttgggcagccaaacaaagttctctgtcaccgccgccgcgcgctctgcgcctgcaagggttaaacggcagcgcacgcggctggcaggcaggatcccggcctgtgggctcaagagccgaggggcgcagggcgaacatgcgagtcccatggcaccagcgagaggccaccaactcccacccaccgagggcacccctgcagctaacacccccaccacgaccac

SEQ ID NO: 24 - DNA, 4261 bp, Artificial Sequence
  Artificially methylated GSTPi reverse complement at Cp[AT]
tatttctctttgtttctctctctctttttttttcttcctcttctagtttgtgaggttcagtaaacacagccaggctgagggctccaggaagccactgactgtgctggaggagctgttttctagtcctctgctctgccctcccaccgacctcgaggctgagaacccctaagccccgtcccaggaaacacagtgctcatagtagctctcttagaaattttattggtcctggagaaaggaaggcaaactctgcctcccgctcagagtccccccaaccctcactgtttcccgttgccattgatggggaggttcacgtactcaggggaggccaggaaggccttgagcttgggccgggcactgaggcgccccacatatgctgagagcagggggaacgcatccaggcagccaggggctaggacctcatggatcagcagcaagtccagcaggttgtagtcagcgaaggagatctgcagggcaggggggctagggactcagccagcgggagcaggctggaggaattgggggcagagggcctaagcccatcccctaggtctgctctgctttgctaaacaaatggctcacacctgtgtccatctggaagcagagggtggcgaggaaggaacagcatggggccagatgctcacctggtctcccacaatgaaggtcttgcctccctggttctgggacagcagggtctcaaaaggcttcagttgcccgggcagtgccttcacatagtcatccttgcccgcctcctgccagacaccaccatgtatcatcctactctcatccctcccagcccctgagacacccccgtctgccccaggccagacaccagagtcccagattctcctctgcttgctccccacaaccaggctagtaccaaatcctgtccacttcagctgccaactcatctctattccattctgcctgtccatccttgctgggttctctcaccagatgattgcaaaagctttagagctggcttctctggaggatccttctagacctcacattcagacacagccctgttcagacttctcaatggcccccattgcccttaggagactccaaaccagtgggttcaaggccttcgggacctgggcctactgcccgcccatctctatctccttacccacccgacacaaatgcaagcgtacacacacacacgcacacacacgcacacgcacgcgcacacacgctgcctctgctgaactggtcccaggtccccaaatgtgctctgtgtctgcatattttcctcagctaaaagtgccagcacctccatccagaaactggcgacaaatcctcctccacctctggctactccaggaagccctcgccaccccaggagatcagaaaccaccagttgctggaggtctctgtccttgcactcgcccccatgacccgttacttggctggttgatgtcccaggcaataagggtgcaggttgtgtcttgtcccaggcccctgggcccctggcccagagctgacccagcccctgcaccctgacccaagaaggggtcagcccaagccacctgaggggtaaggggggtgagggcacaagaagcccctttctttgttcagcccccagtgcccaaccctggtgcagatgctcacatagttggtgtagatgagggagatgtatttgcagcggaggtcctccacgccgtcattcaccatgtccaccagggctgcctcctgctggtccttcccatagagccctggggttgggtggaggggagcaggccgcgtgactgggcgcctgatcaacacacagtcactggggatgggccaaccagggggctgtctgtgagccccagcctgggaggaggggaagaggatgtgcgtggaaggatgagagactgccacacagcaggtgctcagagctcacctgacacctgggaggcagcctggcacagggcaaggattgcaggcacccaggcttgaccttgggcaaactacgtaacctcagtgggtctcagtttcctccactccagagggctgcggggcagctgatttaaacaaaagggctccgggggcagaggcttgcccatgcctgccctggacttggaggttcaagactcaccaagggtgcggcccaggtgacgcaggatggtattggactggtacagggtgaggtctccgtcctggaacttggggagctgcccgtatagctgttgggggaggcatggctcagggaggggcactgagcttgggcgtcccccgatcctagtcacagccccctaaggcccagcaccccctccccttgcccgggcatggtcacttacgcaggaggctttgagtgagccctcctgccacgtctccacggtcaccacctcctccttccagctctggccctgatctgccagcagcatgcgcagggccgcgcagcggcctgcggggagggagaagtacgagatgtggggaccgggccgactccgcctcgcagcaacccggggaggggtcaggagtgcagggagggaacaggtaaacaggttcctccgaagatttcacacaacactggggcggggagcaggcatggcgggagaggcggggaacaggaaggaggcccggggtaaaagccacacgacggagggataagggggttcggatctctccgggtgggcgaggggctgtgggctgcagccccagcccctgcctcccttccctgccagacacatgctcctacctcgaactgggaaatagaccacggtgtagggcggcactgcagcgaacaaagaaaagtttgctggagcccgggggaggatgccaaggcgcggtgagcgcagcctgccccccctccccgcccccggggtcccatccctccccgaggcgctccgggccccctgaaagccgctaacggcactggggacgtcctgggtcccctaggcccccgtcccgggtctcgaggtgggcgaggagccctgccgggagcccgggcctgatgctgcgggttggccccatgctgggagctctgagccccatccccggggagcgggccgcgcgtactcactggtggcgaagactgcggcggcgaaactccagcgaaggcctcgcggcctccgagccttataagggtggtcccgccccgctccgccccagtgctgagtcacggcgccggccgctcttctggagggtcccgcggactcccgccggccccagccccggcggccgctgcaccccgggcgtcggccgcagaggggcgccctggagtccccggagtcgccgcgcagctggccggggaagcctttccctctttcccaggtccccagcggggcctagggagtaaacagacagcaggaagaggaccgcagcgaagtgtgcgcagcgaactggcgcgccgggacatcgcggggggaaattccctaagaccgctgcgatcccggagcttgcacacccgcttcacagggcaggggagaggggtggaggccgcttagaggaaaggaaattgctttattttattttattttattttattttattttattttattattttattttattttattttattttattttattttgtgttattttattttattttatgacgtagtctcacgctgtggcccaggctggagtgcagtggcgcgatctcggcggctcactgcaacctccgcctctcgggttcaagcaattctgcttcagcctcccgagtaggtggaattataggtgcgtgccacatctggctgatttttgtatttttagtagagacggggtttcaccatgttggccgggctggtctcgaactcctgaccttaggtgatctgcacgcctcggcttcccaaagtgctgggattacaggcgtgagccaccacgcctggccgtccaacttttatttgaagttctggggtacatgtgcaggatgtgcaggtttgttacataggtgtgtgcgccatgatggtttgctgtacagatcatcccatcacccaggtattaagcccagtatcccttagctattcttcctggtactctccctccccagcaccccgctcaacaggcaccagtgtgtgttgatcgccgccatgtgaccatgtgttctcattgttcagctcccacttataagtgagaccatgcggtctcgctggttttctgttcctgtgtgagtttgctgaggctaacggcttccagctccacccatgtccctgcaaaggacatgatcacgttccttttagtggctgtgccttaggctattttctttggctttgctgcctactttctgttgatttgcagatctccatttattctagatattgatctcttgtt

SEQ ID NO: 25 - DNA, 6343 bp, Artificial Sequence
  Artificially methylated PITX2A reverse complement at Cp[AT]
tctgcaaaacagaagagaaggaaggctgtaagaagcggcggccgtcgagtgagcagggctcagatgagactacgttacactagctgttaggcgcctactgtgtgctaggcttcaggcgtgtttttccgacctgacagcctctggcatgtgcagcagcatctccagcctagcctcgggcccaggacatttatttatcaagaggggatctccctccagagttgccgcaaaagtgcccagaggttagaggactataaagccacagtgtgctggggaggctgtggacctactttcaagaatctcggtgccggggttaagaactcatctgaacgcaatggcagcgggagtgggtgggtggagaggacttttctctttgggaagctgtatgcaaagaccacccttcagtgcttgtccattagttggagctcggtaaacatttgtagaacatcagcgccaacgtgcccctgtcctagacagcagtttccctcggttttctgtaattctgaaacgaacgggctcttggcctagggtgtttcaggagcgagctgagttcgggcctctcatccatcaggagccacttttccatatttagccacactttctcctagagatactaacccggccatttatttacttactacaaataattaccctaaagtatgatttaagatcgcagaggagagacactgggtggactgagcgagactgaggagagcagggcaaacgttcttggagggtttactgcccgccaaggacggagaaatagctctggtataactgctacccagttctccccctttctctcccgggcgagccaaatctttttcacgttttcaaccacaacgcagcgagccaagcatttaacgcgctcccccttctctgccacaggcaagccgggagaggtgggtctcgaggggctccaccgggtgggtagaagagccgcggttgctttaaagacaagaaaagaaggtccagggctccctaggccccttcgatctcagcgcctgcctctctccacgctaaccagggtacgccgacgaccggagggcccacttcgcgcgggtgcggggatcggggtgggagcaagcgttgtcgggttggcggaggcacagaggcggggcagggagctgcgggcctgcctctggcctgagtaccgtttccctgcgtctcggcctctcctgaagggagctgggccctggggagcctctggccaaggtcgctgcctacaggaggggctgcccggcgctgtggcgtggggatccagggtggggacggccaggcggttcccccacccgctagcgagaacgcgggcggggactctgccgattcgatccttgtgggcccgtgggcccagaagtagcagtttggcggctccagatttagtgattctgcagtaaaatcacaggattagtccctgattgagatgtctgttcgtgagatattacaaaattcattatcacagctttctactaactcgatatgaagtaacacagatgggattttattagtccagacttcaaatgtttacttatgataatttcggaggaaatttgcatgtcatcatcatttcgataatcttttttttttatatgtctgaactggctgcattattagctggtagccggagcactgcagatggtaactgcaaatagtttttatttatttattttttttaaagaatgaaatatacaaaagaaaaagattgcgttgcttggtgtaaagtcagtcaattattacacattcttccccccacttccccgtgcttcagtgctgaagaccaaacaaagcaatacaaaacaaatcttcaagaactcatagagctccactctaaggactgaaaagaaggtcaaggcgtgttccttagctcactcctacatgtccttgtgacttggagatttattttgcagtcaaaatgagccttgagacttgcatttttatgcttcatttaatgaccaggcctactagaagaactgagtctaaataactggggaagataattttttaaaaagagacctccaattcccgcctgctgatccttaaacttgccctatcaagacaagtcttctgtgagaaatttggctgccagacttcggaactggcttcaatggctaatctcacaaattgagatgggagacttttcctgatgggaggtagttctcacccccaaagttcatgttctagttggaatgtatatgccaaggactcttgttttggccaacttgggttttatattgtgagcacacaaaaagcactacacggctaacggaggacgaggaaccatggcaaagcaggcaggcaagccctaagaaataaaacaatttgctaaaaaataatttctgatgactaccgcaagactgaaagtgcaggaaaaatacagttcgaataatcccagatcctttcacatttccccccttttcatacactttgttaccccataacaaaatctttaatggaaagtttaaaaataaacagcacaggaacatgtgttttaaatgaactaaattgtgaaattagccagtaaattaatttgtagtaagtaattatttaaggaaattaaaatactgctcagttcagttctgtattttaccatgtgtatgcgttctttacaaccaattaatataagtgctttaggaacatttgaagacaaacacgcttaacttaaggaacaaagcacctaaataatttaagtgtaattttgctgagttaaagtaaaacattccacaaatgaagtggctatttaattttttagggaaagtttggttattgaaatgttgtatgctcatgttacatcaacaaaaatcttcaatttattttgcttatgtgctttgttttcttgatattattggtatttgaattttagatggatttctgccaaaatgatattttgtgtgataaaagcatctttagttttgattgatagactaaaacaaatgcaaggaaatttctttaaatcagattaatttttcataaaaatattttagaatgtatgaattctgatatttacatttataatggtaaaagttttttccgtttagtttagtaagacaatactcacacaaaagagtaaaaaaaaatcacaccaccttatgatagtttgatttctaaattgcttaagaaagtaaagtggttaaactggaaaagaggaacatatttcggaggtttagaatcgaaaatttttttcttaatctccagctggaaaataattctctgcatccatttaaagtgtatctcctgaagtgccagattggagttgactggtgatcaatttaaaggagttacaatccaaagaaatggtgagagcttggcatccaggcctggctcccaggtaattcgcttgggcctgagaggtcactaactgccagttaagatggaatctttttcttttcttttttttcccaatggataacaatgggaagggggctaatcttccagtagctgaaactttgtacccagccctttatcttgagaatgctaatccttggcccgaggatttgttcctgcagtgttggcaccgagatttaagggaagatacctcgttttaaatgccagccacggtctggcttccctctcgacttcagcaccctgtagattgttagtgtctgtggcgggggacgaaaggaacagggctttgcaaggtctgtttgccgactgcgttaccttgggcgaaacttagccccaaaagccacaaatcacctacggtgaagattctccgaagtggaacaaatttccagactcgcattatctcacatccctgcgggatagatggcctccacttaccggctaccgggagagagctgctgtctccgcgtcccactgcttcccggggcgatttccagcgagccgagcctccggctgcacggcaagcgcccgaaagccgggcctgagaggactgcagggctcctgagggtgccaagttccgaaggagtccacgggtgcactggggcctccgaaatctagccgccactggcagtttctttctgctcctctccagctttctcgctcggtctcgcactctctctcctctccctccctctcatccctctctcttccctctgctcctactccgtgtggggagtgacgtgacgtcagcagagattccaccaaactccactgcacagtggcgcgcgggcgccggcgagcccgctgcgcggctggcgatccaggagcgagcacagcgcccgggcgagcgccggggggagcgagcaggggcgacgagaaacgaggcaggggagggaagcagatgccagcgggccgaagagtcgggagccggagccgggagagcgaaaggagaggggacctggcggggcacttaggagccaaccgaggagcaggagcacggactcccactgtggaaaggaggaccagaagggaggatgggatggaagagaagaaaaagcaatctgcgccaacccggcagccctaataaatcaaagggggagcgccagggcagcggggagacagaaacgtacttttggggagcaaatcaggacgggctgggaggaagcgacagggaaagtggcccaagagacggaacaaaggacaatgttcatggggttgtttgggacgaggcgtgtggagtgtgggtgtgagcgtgcgtgtgtgaccttctttcaggcctgcagagttgaggaaagaggtcacagcaaagagggactgcggagggaggaaagtgagagaccggtagagggcgggagtggaggtgggcgcggtggggatgggagaggatgagtgaagagaaatctagaagaatggagtgagctagtgggagagggtgggagggccacagccgggagcgaacgagctaggcttgtcagctggggaaggccgggacgctgggcccagcttagctgggacaccgcgcccgaggtcaaggcgggtggaccaggcatgctgagagtgtcggcgcacaggtgggcacggccacgcactgacccagtgttcacgaagggtttgcactggacaaggctcagacgctcatagagtctagaatttcctctgctgtacctacattcaacaagttcaccctgggtcacggatatctcattttttaaaatgacgaggttaaggttcctggcgaggatggtattaaattgcacgggatagaagtgggggtgggggagagagtttccctcaagtccacatttgctcctgcaaagcaaagagtatgtgaaattacagggcatattctcactcgaaaagtgtgccttacttctgaaccctgattttctgatttcttgacttgagcaaagatgtgtattttggtagtgagcagaatattttggctctgtcctgcctctgagtggaaggactataaatataattcgcctggaggaccaggtgtgaaggcttctgccaggcatatgggacaatgttttttcaatctcaagggcatcctgttaatgtatgtttttggaaagtgccggaacacagccattgctcctggattcggattttcccaccaatattaattcctgcttgagagcaaaactcaggcccgctattaaaaagacatctctttggtccctaattgagaataaagttccctctaaaagttgtattgctcttcctaaatcaatataccaatactcgcaattttagaaatatatagtgactcgggagaatgtgcataaaatagatacgtttaaaaaagcttggcgcttaaaactaaccctagtcactatataggtgctgggctttccctacttttgggggctgtctggaacatgttatgtgttttcttgaattactccgtgttttgaattcatttgagttagcagtaaaaacaggcaaacaaacttgctcaatttgttttgagtgctaaatcccttcactttgaaatagctaacagtcgacagatggactcattttatggaaagggttagcctcttcagccacgaagaaaactgattagagatctacattttaagccatttctaacctccacgtaacatccgtgaaaactcaaactttctctctttacccagtggaaactcaaagcagtgttatttaaggggagagaaatgagggggaaaatgcccacgtgctgtttaattgtatttcctctctgactctgagaatttctatttctggtttttgaaatctcgccgaggcaagaaaatcaaatttcttcaacaagtcccacaactgaactctagttacaggacaccggaaagtgcagtccgagaaagacatcttcacctctgcccatcgacgatttttgcagcctccccattcctctgagtaatgggctaataatcctccctttttttcttttcattttgtagagattaagaggcgctcgtagcagaacggccttgccttcagctggtggcgaggataggcaatc

SEQ ID NO: 26 - DNA, 9001 bp, Artificial Sequence
  Artificially methylated PITX2 B reverse complement at Cp[AT]
tgtaaagtgattaggagattaggagaatgttgaaactcctgctggaaaaatgcaaagaaaatcctcactttgagtcagttgtttacagagccagtgtgtgtgtgcgtgtgtgtgtctgtaatataaaatggatgtgaatatatatatacaaatagatatggttttgcttttactttaatctgaattatctagataattgtctttattcaccacttgacttcaatgggtccacacaaattaggacaccttatctttttaggcatctaggctgctgctgatccccagtgcttccaacatctcgcacacgttggcactatgaggagcagtcacgtgcccttgggtttttcaaccactttggaggctgattgaggtccttcatacatgtatatttgtcgtgatgaaagttccatcggtagagtggagccaccagagcttttatcaaaattctgtgggtttatgagagatgggtttagaaatctatatggctctgtggggcttctcggctttctaaaataaggcattaacacccaagcttccaaaaatatttgcagctctggggtttgaatcttgaaaaacaaggagtgaggggctgtgtatactaactacagtggagatttttttcattctttaatgtgatggagtcccttcatgaaatgaagctttaaggggcatggtattgtggggaccacagctattctgaggtttaaaagaagaaactggaatatgattagtaaacacattcagcagaaaagagctggattcttattgacttagttataggtcatcggctggcagtgcaatgggaggaaatatttactttacacatatactttatgatcttgggggaattagaggaaattcaataagaaaacggctagaaacatttaaaacccttatttaaaagacttaagcaaattagagtcttatcagattaaaaaccactacaaatgtaagagcattgtcttcagtgaaacgctgtggggtctgagaaggagattctccgccaaatctccgggataaaatgcgtcatttaagcaccagataatgagcagaatgtaaattaatttaaccttctttaccaacaggctgctagtgtaatgtgtataatttagtgataagattgcaggacctaatatagctggatgtatgagcctcagctaatgcagacctgtcacatgaggatgtgttttactctgagcaggtgtctgtatgtgtggaatggggtaaagtggaataaaaggttaaaagcagaaatgctgatttaaagcttactatgaagaaattcctcccttgcagctaaattattcttaaagtgggatgatactggtgaagaaagactgaaaaacaattctcatgtgcgtctttggactgcaagtttaaaatggggaggagttgcagatagggtttgggggtggtcagggcaaaggagagacacataagttgcaaatatatttgtagtctgcttcatccactttgttccacatcgaataagtttcccaatcttgtgaacaaggacaaggagggagtgttttaaagatacttcatgctggcattgcaaatcattgactgtaatgtcaaacaaatacacattcagagatgataacactaactccatagtaaaacaatcgcccatgcagaaacccagaggagattagtttgtcctctccagctgacctatgctgggggacaaaaggactttcaaaaattattttgaatatgtttggatttctttctttaatttctttggaaattaaatttgcttggaaacagtgctataaagagttgatgtctccaaaggtgattttttttgttttatataaataaggttttgcttttgctagttgagcgcagttctaggcttttcgcccttagctcacacacaccccttctgcctgcttggactttaatggctcaagacagccttgagctcactgggaaaagaaaatgactgttaaaaattatccttgaaattggttatttggcaacattcttaattgtatggaaattcattaaggcatatttcatatataattagctcaaggttgttgattctacaggctttatggatttaaatctgattgataataaagtaaacaagagagtcgaatttaaagcgtggctctctcgggttaggacgagcttaatacagtgtacaaggaatttgaaagatctaggatatgtgtcttaatcaacgttaagtagaatggataagctttcagcattttgaaaacgctgggttagggtttctcttctattgtgtgttttctgtctggggactaataagcatcacagagaacgtgatctgaggcgactttttattcttgtataaatccagagtgaaccaccaaacagttgttcgtttaaagtcaaggtaattttcttttgacgggtccatttgcttctcgatttctaatttattagcctgccttttcagggctctgtcttctttgcaattaaagcttcttcagattagcgcagcattcacttgacaggctgtttggaaaatttaagatcggagaggtgatttgttgctgtttttcaaattttctagttttaagtaacgtgtctcctttttatatggggtgggggattggaaatggatgtagtgagacacaaagagtgggtgtcttgttgatccttgtacctttctcttcttgaccattccactctcttctcccaagccttcgactcctagcctcatctcttcacctttgggttcgtactaaaagccggatcgccttgggctgggcaggagctgaattcccgggagcttgcctgtgtagacccagtgcgcacggcgaggcagtagcccggccccgcactgctgataggtgcaggcaggacagtccctccaccgcggctcggggcgtcctgattggtgcggagccacgtcagtcgcacccggagaagggtctgggaggaggcggaggcggagagggctggggagggccgcggcggagtgacgtctcggcaccaggaagcccgcctctggttttaagatgttaggccaacagggaagcgcggagccgcagatctggtccgtcgctcgcctgggtgcctggagctgagctgcggcaaggcccggctcctgttcgaccgcccgaggggtgtgcgtgtgcgcgttgcggagggtgcgctcagagggccgcgtcgtggctgcagcggctgctgccgccgcaggggatctaatatcacctacctgtccctgtcactcttgacacttctctgtcagggctgccgcgtggggggggggcgggcagagcgcggtcggcgttagctttccttattggaggggttcttgggggagggagggagagaagaagggggtctttgcccactcttgtttcgctttggagcttggaagcctgctccctaaagacgctctgagtggtgcccttctgcccacatcccatgtcttcgtttgcccgctgactttccgtctccggactttttcgcttgagccttccggaggagacgggggcagcttggcttgagaactcggcgggggttgcgtcccctggctctccccgcagcggggaaactccgcgcctagagcgcgacccggagcgggcagcggcggctacgggggctcggcggggcagtagccaaggactagtagagcgtcgcgctccctcgtccatgaactgcatgaaaggcccgcttcacttggagcaccgagcagcggggaccaagctgtcggccgtctcctcatcttcctgtcaccatccccagccgttagccatggcttcggttctggctcccggtcagccccggtcgctggactcctccaagcacaggctggaggtgcacaccatctccgacacctccagcccggaggccgcaggtaaggcgccgcgccgccctgcagacattcccgctcagctgctctgcgccacccgctccctctcgccccaaggaagtcagcccctccggggggaggcgtggtgggagtggtcgttcgcctggctccccgcagaacttccgggagccggaattttgactaccccgcatccctttagttctccctcgaccggcccggctcctggggcgctaagggcgcgagcaattctgccgccctctctattcgtaccctggcctcccttctgtttcctgggtcacaaaaatcccagcatcttgattcgaggaccttcagaggccgccgacctctgtccctgttttcctctcggctttcagctcccgaggagctccactcgttaggaaattgcctgaaaccactcagaaatgcccttcgcgaagaggcattttttttttttttttgggaaagggccggcgaacttcggtgcccaaccgaatccccacatcttttcctagccttcccaaaccgcatggaaatctgagctttctgcgagggggaggggggtctgtaaaccacgcgcgtgtgcgcgtcccaggagatttggtgtgtctgcgcagaggtgtataaatatacttgaaagcacaggctataaaagtgaatgtgccgctgcagtgagataaacatgtaaataaaacgtgcggcgctgggggaggggaggaaatggggcgcggacacccacacttgcgcctgcacaccccacaggcgcagcgctcctcgcggcccggagccgccgcgcgcaccctcctccggcgccaggcagcccagctcttccacggcttctgccgccggtccagttggcgtccgcgttgcaggtgggcatgctgacgggaaagtgtgtgtgtttcgttttcagagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtaggagccagcacggagtctgggagggatggggggaggatgttgtggaggtacaggccaagtagaccaggagagaatgtggaaggcagcgccgcctgggagggcgccggtggggcgcagctttgcaaaggcagaaggcctcgcggcggcctggttgcgagattacagttccctctccgaggccgacaggactgccgccctggctcaggctcccagagcggcaccggctcactgccccgccatcccgcgatctcacgagctgggctgcatgggcaatcccctgcacaggacattgtgttcctggcttgcagttgccagagcagagctaataaaatccctaccaggccaagagccgcgaacaggctccaacctgtgagcctttaacaaggaaaacccgccagagacacggaagagttggccctccctgggaaacctttgtcccggccctggcccagctttttccctcctgggctcgcgcttcttacaccttctttacggttgtttcggccattcaggtctctcccacacaccctatttcctagttttgtgatctccgggagcaaagttttaatacacaactactagtcctcttagaaggagaaagaaaaaaagaagaaagacttttctgcttggtttatttatcttctctcaggagttgaactctggaaattgaaactcacaccccctcttctaaattataatcatagttttgtaaaaagggcttaccttaactttgtagcaaatctgtactttatggattggcaaaaatgagctcaaataaataacccaatagcaacgtcctggtttatgctggtcggtggaagattccaaatttgttaggattctggaagcagaaaacagaatcaagcaaatcaagcggcatccagaggctttgctgttaaaaaaaaaaaattaagtgctctgggtagaaaaaataaagcccccggttagagcagagcaaacaaaaagaagaaaacaacgataaaaagaataaagaccaaaatgctctcccaaatcagagggaatgaagacactctctgggtggcatttgtgcaaggcatgaggctatgctggtggataaaaggccgggaagaagttgaaaatggttttagtttaactgtccagagccagagctgggtcctgggcggcgtggttttgagcaaggtcagtctttcattagctctcttgcacatcaagggaacgggcctctcacgtactcttctcgcctgagcaaagtttagatggcctagggtagaaatggcaagtaattaaagacagagtctatgggttttctgggatccttcgaaaacgccctcccaccccgcccgctattccgcagctccaccctagtgctttgtagccgcggcgctgggctctccttgcagctgcctctccttccagggcggctgcttgtcgagccaagtgggagtgaggcgtgctttttatagcagtcgggtgcaaagaggaagggggataaaaaggaaatcaagaatgaaaggaaaaagagaaaaagcggattacacggctgggcccggcggagatgtgtaatgtgaaacatcactggtgtcagctcggatatctcaggccaggcctctctccaatacacaaaagccgccgtctggggcgacagggaggcccgatgtggattgggatcggggttgcggctgggccaccggacacgggtggaagccggccggcctgggtggccgcctgcaaagccaaacgacccggctgggcctggcgcgcggacaggcctgtggtgggcttagggtaaagaagaggcagagcgaaagaagggggaatctccaaaactaccctttccgggttcccggagtttaatatgccaagctcctggagttaacgagctgacgaagaggtggtcttttgctctttatttggttgttttgctaggcgagaaagagtgttggcggcctagtccctgttaagggagcacgtaccagggggtgggggacgacagtggaggtcagggaaggaagggaggaattgcgtgggagaaagagcgatcctctagtgcccttccagccccttctcctcatccgtgggtctgtggctttggaatggaagcaagtttgcaaggtgccccgggaagggttggaaaagcctgctgccccgcgtttgttttacattaagtgtttttggacctggagaaacgcctggctgagtgatcaaaccgtccgcaggtctccatgcgttcggctgaggtttgtggcgtagctccgagtcccagctcgcaggccagagcagaccaggtctcctgcgcttggtggagacccgggccagtaactgaaagctggccctggtatcttggtgtgcagggcggtgcagtgaagcgaggccagggtgtgtgagtgcgctagcgtgtgtgtcgggggaaggcgggggttggcctccgatggaagttttagtaatctgcactgtggcatctgtttgctcccttgccccaaccgcccccaggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttctaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaacaaatgtgttttatttcatgggagtaaaatatactgcatacaaattggtctggattctttctcccctcctctgtcactaacttggccaggacatctcagtcactgcttcctaaacaaaccagttccctctgcctgcctagttaaacatacaaggcagcagtccttatttaaatttggtagaaataaatgatagccattcatcagaaactaaaaagaaaaaaaaaggcattcccgggggggaaaagggctacaaaatctaattttgtctctccaatttttctttggcttaaacctagaggattccattatggctagcaaataatatgaaaaagaaaaaagaagaaagaaatttagcaagtccatcagct

SEQ ID NO: 27 - DNA, 1920 bp, Artificial Sequence
  Artificially methylated RASSF2A reverse complement at Cp[AT]
tgcagggttggggataggcacgtgagggggagaactctgagtagatagggaacctgcagccgggctgctcaagggcctctgtgtactgggggcgccaggaggtccagggatggaaaagggggaggtgagaaatggacaaagaaacttggcctccttggcattgctgtcacgtctggccggcccgccaagtcgaaggggcctgtttagcccctgtccggctcaaacccttttgggaataagctgggatgttagaaaaaacaaaatcccacaacctctgcctggggaatccaggccgctggaggtgggcttggtagggcagcgtgactgttccctgggagtggctgtcacagctccgggtgaaccgaggagcttgggccaagtctccatccctcttggagagggcagcagcaaggaggtgaggggagccagctcatcctccccaaccctgcactccccccccacctccccacccccagcccggaagaatcgctggcggcgggagcctggacgagctggcggggaaggggacgcagccacagcattgtctgggagggaggggagaagctccgcccctagaggggaggggagaagaggagggggcaggagacaaggggaggaagaaaggcgaaggcaaggcgaaggggtggagagtgatatgaagagcgagagaaaagagaggacagcggacgagcagatccggtaggggctgaaaaaggccaaggggctggagggagggagaggaaggaggaggggagcgaggagggcggggcgcccggtccccagtcgcgcggccaccgcctgcccagcctggctggatttgagcccggcccgccgatcgctggccgaggcgcagctgaagcagccccccagccgcggcgcccccactttccaactccacggttcctgcggcgcgggcgcgatgcagctggcccggggtgaaggcaaggcgcggggcgcggggcgcggggcactgggagcgaggcactggcgcgggatgcccggcgcaaggtgcagggcgcgggccgctctctttccgcgtccccccacctcgccaaagtttttccacgatggtccctaccccggctgggtcagccccgtaatcctcgcctgtctcttgtctcctctttcctccccgagccgcggggctcccggggcgcgcggacccccgccaggggccgtgtaggcgcggagccccagccggcctgccttgggtccgaagaaagttgtggcttggagctagtcctccttctacgacccctgggggcgtccttccttctttttgagcccgcgatgggaaggcgctcccaccccatccccggggtctctgagacttcctggcgaggtggggcggcgcggcaggtgcagggctggggagggcctgacagccctggagagtgcccgaccccagtccgccgccgtcttctaggcggattccccagaggcaggtcccagtccccggcgcggggaggcggcgcgcttcagaggggcgcagggtgcgcgggggccgttggccctccgggcacttcccctttgcggtctccccgccctccttcggagctggtgcctgaggtcgctgggacctcagcctggcgtcttctctcgccccgagcgaggcaggtgccgtgggcggccccggctacttctgcatttcgagcgcttactttgcattcagctctaagtcggagagctctggggacagccgagagtgccagtggcctcatagggagactgagggttctgtttcacctcgggcgccgtgtgggtctgggctgtccacagcacctctgcgcctcagtgataggagaagccaagcgcgaggcctctcaacagctgcgtgcactctatttcccaggtatctggaatcccggcgcctagaacgtgtttttcgggagagcaaaggctgtgtctacggcagcctgg

SEQ ID NO: 28 - DNA, 5473 bp, Artificial Sequence
  Artificially methylated SHOX2 reverse complement at Cp[AT]
ccccacctcctgtcccattgatgtgttattattgggggggctggagcagtaaaaaaagaagaaggaaaaaaagagcggggctctgctggcagaggttgagcgccgggctgacgtgcggcggcgatggaagaacttacggcgttcgtctccaagtcttttgaccagaaagtgaaggagaagaaggaggcgatcacgtaccgggaggtgctggagagcgggccgctgcgcggggccaaggagccgaccggctgcaccgaggcgggccgcgacgaccgcagcagcccggcagtccgggcggccggcggaggcggcggcggaggaggcggaggcggcggcggaggaggcggaggaggtgtaggaggaggaggagcaggcggaggagctggaggagggcgctctcccgtccgggagctggacatgggcgccgccgagagaagcagggagccgggcagcccgcgactgacggagggtaacgacctgactgacccccggcagcggttccccttcccgccttccggactcctctcgggcgggagaggactccgaggcccagcggggaggggagagggacacggagagggccctggaccccagctttgtcagctagagtgatagtggaagggtgggggtccggtggtatgctcggtcatgggtggggtcctagtgtgttgtgggggtggcgtggggggaagcgtgtggggtttgtgcgcgcccttcccagatgttcccattccaccgaaatgcatttttcaccagcgggaggatgggcccgcagcccggatggcccgcaggcggacgtggaagttcgcggggccgggctgcaggagggggtgctgaaccagacggcgggactaaagctagcctctagcgcagagtttgccgggagggagaaggggcagaggtggaaagcttaaccctccggtcgcctaggtgtttggggccgccaagacccctcgaactccgcagagcccctgaatctttggatcttaggggccaaaacttcccattctctttcaaggtagaaggaagccaacgaaagctgaggtccaggctacgctgcttctcccgggcgaggcgtttcggtttcttggtgtgttgggggcggggggggggggcggcgggggaggtggggatctatatttacacaattcctttagtgttttcaatcacccagtactcggttctcttagagcaaaaatcctttggtgctagctcagtgttaggaaacgtctttatctcaatggcagagcgttctataccaattcaaaggagttcaacaataaaattgatttggcacttggtgcctgcagtaactggtgtactgccatatttttccaattaagaaaatatgtggcatgcgtggaatcacatatttaagcaagcaattaagttgtttatgacacggtctgttcctgtttagatcagtaattggaaatttggggacaaaaatagagattttattaagtctatggatcaacttgaaatttggacatctcctcgaagccccaaaactttgagtggcatccactgtgtagatgacatgtaatagacaaagccttcccacctcattggcagaatttgaagggtgtgttttcatatttaaatttcaatacaatatcagtaaaaatactttgctattaaattggcccataatgtttactataatgttccttcctaaagaaaggacaaatgtccacaaaactaactctgagaactagaaaatacggcaatatttaagatcaccgtagctagaatgcccggcagggccgagatctagcgactcttcttcctccaaaccagcaccaggtcttcctaaatttgtaaagtggtggagttaccgtcaaggtgcccagtgcagcctcccggccatgagtccacaactacaggcccgaactacaggttcgccagcgcgcctgacggcgaggttcaggtctgaacccccggcgggcgcagttcctgggattgttgatttccaagctcagggcaagtattaatttctctgcagaccggctcttccggaaatgatttttaacacccatgctggcctggatcctgcgctgggaagaactgcaaacagcctcgactatctaaactcagctttgacttcttaaaacccggagtctctgattcgggcgcagaggataaaggttccagggggatatatatatggtggctgtatatgctcacactagaagagctcctgtttttaaagggaggagaaggacaggaaagtggcaacggatgtgtgcaaacccagagcagaaaaattcatattttattaaacatccgagctgctggttgcatgaaaaggctttgagcaaccaatagaaaccgaggatcgcgaatattccgcttgaacctgttgatctctgtgggttaagcgtttagggtcgagtctgcgtttccacgagggagggcgaagagagaacagaaagagcggttgctttcgcccgccaccggaggctggttttccgcctcctgccttctggcccggcttgggcggcgagccctttgggcagccaacatggcgtgggcgcctgtgctcgtgcgaccccggtcgggcaggcgggacggagattacctggctgtccaggggaccttatgcagggtttggcccgagcccaggggcagcgaggggcgtctgcggatgcggctccctgtgcggcacaacaccggggtctgttgctctcgctgatacctttcggcccaattgttcctaaattagaccagcaagtttgcggtaggcagagagccagcggtggtgagagctggcctgagaacgagccagccttctgggaatggccggtgtgagaggccagtgggtggccttgccgcgcccttatgtccagactttgctctgtgagaggcctggcgctgcgcctttgatttctgtgagtgctgcggagcaagtgagtgcgaaagtgagtggaaaccatttggtgtttgctggggaaggccggtgactggggggtgaatagtgaggcggtgagtcgaggtacgtttgtgaaggaggtggtggatgactgcccaccttgccccaggcggccgctcagacttgacctttgcgcttctccgggatattcttcctccgggtgggttgagaagccggaccaggattccacgagggggaaggattctctattcttttttgcgacaaatctggtaacaggatttgctgtgctgttttcgtccgtgtgtgtgtgcgtgtgtgtgtgtgttcgtgtggatgcacgtgtggccccgctggggtgccccctccagtgtccccggagctgaaagatcgcaaagaggatgcgaaagggatggaggacgaaggccagaccaaaatcaagcagaggcgaagtcggaccaatttcaccctggaacaactcaatgagctggagaggctttttgacgagacccactatcccgacgccttcatgcgagaggaactgagccagcgactgggcctgtcggaggcccgagtgcaggtacccagctgccaggaggtcgagggcccagggagcagagagagcctggggttggaaagaggcttgggggacacactcgggaggtggtgcttctagtgtctggtgtaagatgagaaggaaagagatatctttactagaggtcttattttccaaagtagatcttagtcctatagcactcccctccttttttttttttccatcctaacatatgttcccagaagaagaaagctgtgctgggctttctcccagagtttctataaaccacaccccccttgcctcgcactggctttaatgtggtttaatcctaatgggcctacttttataaggcttaaaaaaaaatcccacagaaaacgttttatctctggatgccttaaaagttccaaagagtattttgttctctggagttggatttccttgaaagtctgctctgcagggtctaggtttgtcaagcggatatcccaattaggtttatagatgtgcagactataaagaaaattagtaactgttaagtgcagaaatttacagtctgctgttagcggtcgatctcaaactgtgtgtgaaatagcggagaaataaacgcattttggtcactctttgttcattcatttaaccaaggcaacgaaactgaccctaaatacattagattttaaaacaaaccacatatattagtatttatatttccaaagcctgccctccagcacgtgccatacccaatgaagttaggactgaaacagattttctttattggttgtggaggcaaatgtaatagcaaaaataggctttgggggcatttaaaggagcaaattgtgtacattcacatacacatatccttctagctttagggggaacaaatttaaatgtttcagattgtatttccgctcagataataaaatagaataaaatgatagttattattggtttgaacacatggagcagttttaggcccgcacatctgcagctgttacaaagtatcgctgtaacagatactctttcggtctctgggcacagagaccaccatctgtagcgaactatgcacaattcttaaggggcttccccacatcttgtaacaggatcaggaaaaaaaaaaacagagcagtcacgttgaagaggaaaagtaataataggctgccttggtcatcacagcatcagcagcagagccttcctttttaagcctctcctgcttcgctctgtgcactgagatctccagaggctcagcaaccccttaaaaacatgatgataattattacagttatgattattagtatcttaattccaactcttctaggggaaaaaaaggcaagaagcctcaggccatgtgaattacacaaaggatgccaccctggcacaaaatccaccctctgttgtactaaatagcagagaaatttttgaagatttacattgactatgacacttgctttcaaaaacataccaatgaaagctctgaagcagtatttttactttaatggggttttaaaaactttaatttgtgagtcaatcaatatgctttattattgaaagtggaatacaaaagcaagctttatttgaattttaaaaaatctgtcatactgcctgtaaaagttgtcaagtttaagcaggtaacatccaggagaacaaagtacctaagagttacttgctttatatatacttcattctcctttcgctgagtgctcttctttttttctcttaagaagtgaactttattgttgtttcatacttttatttacattttagttattttctagatgttttcctactatcctaactgcaaacagtggctttttctaaagaagcaaattagattatcatgataatggtgcacaattattctgctactgtgtttcactctgctgcacagcagaacagagaaattctaaacttctttgtagtgaggcttttatgacactaattacctctccccaacccttacaactccttctccgcaaaggagtcattatttgctctggtgtttggtttttctttaagatgaagctaattaacattac

SEQ ID NO: 29 - DNA, 1405 bp, Artificial Sequence; identical to SEQ ID NO: 22
  Artificially methylated Septin9 A reverse complement at ggcC, agCt, Ccgg

SEQ ID NO: 30 - DNA, 2365 bp, Artificial Sequence; identical to SEQ ID NO: 23
  Artificially methylated Q9HC74 reverse strand at ggcC, agCt, Ccgg

SEQ ID NO: 31 - DNA, 4261 bp, Artificial Sequence; identical to SEQ ID NO: 24
  Artificially methylated GSTPi reverse complement at ggcC, agCt, Ccgg

SEQ ID NO: 32 - DNA, 6343 bp, Artificial Sequence; identical to SEQ ID NO: 25
  Artificially methylated PITX2A reverse complement at ggcC, agCt, Ccgg

SEQ ID NO: 33 - DNA, 9001 bp, Artificial Sequence; identical to SEQ ID NO: 26
  Artificially methylated PITX2 B reverse complement at ggcC, agCt, Ccgg

SEQ ID NO: 34 - DNA, 1920 bp, Artificial Sequence; identical to SEQ ID NO: 27
  Artificially methylated RASSF2A reverse complement at ggcC, agCt, Ccgg

SEQ ID NO: 35 - DNA, 5473 bp, Artificial Sequence; identical to SEQ ID NO: 28
  Artificially methylated SHOX2 reverse complement at ggcC, agCt, Ccgg

SEQ ID NO: 36 - DNA, 1405 bp, Artificial Sequence
  Bisulfite treated Septin9 A after artificially methylated at Cp[AT]
tgttatttgagttgtaaagggtggctttctgtgtctgttttgctgcattgatacattgagctgtgcatggtgttcagtgcagggagaacaaatgatcatctgttcaatgtgttcatttacaggtgaggaaactaaggcttcaactcaattgatgcactctgttcttttgattatcagaaaagtagcaggacaggtgttctgttttgttctattttggttcactaagttggcattttggctttgatttttggctgtgtttggtgttgttgtggtgtttggtgttgttgtcttgtttggtggggttgtttggagtgtttgcatctttgtttgctttcatctggttgggtttgttttgtttggacttgggactgggaagtgtggtgacttttggaatcagtcattggtgtcagtgtggggagctgggggtgcagagctgtgggtgtggtgggtcatgcaggtggttttcatttttggtctggtctggtctggtctggtctgtgctgttgtgtgggggtgttttctttcaggtttggtgtttgtcagttttgctttgtcaggtgcagtgcagtgcaggggtgggtgggggtggggcttggtgtgcatgttcatggggtggggagggggtgggtcaggggtgggatcacagttggctgggttggggttctatgtgcatctttggggaggggtggggtgggggtggggttggggtggggtttggttggtgcacttcagatggtgggttgttttctctttttgtctttctactattggttcaggattagtgttctgggagtgtgtgttttgctgtcttgttgtcacacttttctgggagtggtggtcatggaggcatcatgaagaagtcttactcaggtgggctttgtgtttggggtggggaggggttggtgttttgggatcagtgctgctcatctgagtgtctgtggttgggagtggtgaggtgtttttggagctgagtgagtttttgtggtgggcacactgcaggttgagtttctttcaggacagggttgctgttgggttgcttttgatctgagttgattgttttctgtgctgtcttcagttcttgcttgagtgttggaggggctgttctgggggatgctttctctttcttgtttcttgcattcttgcaggaattgctgacttttcaggttggttgggtgctttgggtttctgtgtgtctgtgtgggtgaatggggttggggctaggtggaggggtgttcttgggttcagtctctagggctggtggttcaggttgcagcattctttctttggattctctttggtttcttctctacttagtggggcatgggatggtcttcagatgggattgttcagcagtgttcaaacttggtgacttgggttcatgttttgtgctcaggatgttgtttgt

SEQ ID NO: 37 - DNA, 2365 bp, Artificial Sequence
  Bisulfite treated of artificially treated Q9HC74 at Cp[AT]
gtggttgtggtgggggtgttagctgcaggggtgttcttggtgggtgggagttggtggtctcttgctggtgtcatgggacttgcatgtttgttctgtgtttcttggctcttgagttcacaggttgggattctgtctgtcagttgtgtgtgctgttgtttaattcttgcaggtgcagagtgtgtggtggtggtgacagagaactttgtttggctgttcaaatacagtcttctgcagaaggattctgtgtttggggaaggggaggaatctctttttctctgggtgtttgttcttcttgtcatggtttggtcttcacatttgttcacatctggttgcagtggggtgtttggggggaggggctgaggttgtgtctcttgttgttttctgggtgtgggtcaggtggggaggaggggggtgctttggttgtgtgttcaggactgtttttcagtggtcacttgggtttcagtttttcaggtctggtcttgacaggtgggtggagcagtcagtgtgagacagggaggttggtgtgggtgtgggaatctgatttgtttgggaggtgggggtggggtgggggtgcagtgtgtggggaggggttggtgtttgtctttctttttcattcattcagctgagtcagggggtctaggggcttctttggtggctagctctgcactgcaggagtgtgggtgtggtgtttcagtcagtgtgcagggtttgggttttgttgggggtgctttcttgttgctgttctttgtgtgatttgctgttcatcagtcatcatgttggattttgtggtcaatgtgcagctggatgggatcattttggactttgaaggtgggtgctgggctggctgctgtggttgtggatgtgctggagaggattctgtgggtgggtctggtgtgggatgggggtgtgctgaggggagatgggagtgtgctgaggggagatgggatttctaattcaggtgttcttttgctgagagtgttgtgtgtttttggttttgtgtttgtgttgtctatgtgggggattctgttaggggcatttgtgtagattctgtgtgttctcacaggattctgtgcttgttctgtgcactgttgtctgggttttctttcttttattgttgtttgtgtttgtcaagtgacagtgatcttcttgagggcttgtgaggctgtcttggaactcttcaggatgcacagtttcactctgggaaattcattggttttctttctttggctctttttggtggctcttgggttttgcttggatttggcaatgggatagggaggttgtttctcatctttgactgagtggacagttgtgttctgcttgggtggacagttcttttctttttcatgtcagttttggggttgtcaagttgtgcagtttgtgggttgggagcattgaatggacacagttcaggttgtggcagggtctagagtgggatgtttcatggttttcattcaggtctggggatattctcatttgtctttcagaattgggttgtgggggacagaaggggtctgtgtgtgggcagggagagtattttggctctcttctgtctttggggtttacaaagtgtgttgggacttgtggggctgctctgttcaagtctgggtctggtgtttgtgtctctgagtctgtgagtgtgtgtgcttttctgtgttctcttgactgttggtgctggggctctgtgttctgtgtttgtgggagtaaatacagcaggtgaaggggaagctcacacaatggtcttcagtgctctggggcagggcttctgaggggtgggtctgtctctgttgggatctggagtttttgtttcttggagaggcttctaggctgacttgggcagagttctctggtgggttgggagggggaaaggctgtgttgaaatgagcaaactgttcaggtgtcaggtcaagctgggaggtgatcagtctgaggttctttttgcttcatggtcagaatcagggctgacatctgggtgttctgagttcagctgttcacatggttcatctggggtcagttctatctgagtgggggaggtggggtcttctgggggatcagaactttggctggatgtcaagcagagtgtcagtggctgttcttcagggctgggtctgaggagggtgtggggtggtgaagggatgggagggggttgtgattcagtggtcactggtgctgtgcagagtgtgagctggaaacattgtagttactttgtcagcttagtggtgaaagttctttttcaggctctatttctttgcatttctgcttttcagagggaggggaggtctgggtctgcagagctgggagggcttgctgtttttgtttttctttttcacaacatcttctcatctggacatctttgggcacatgt

SEQ ID NO: 38 - DNA, 4261 bp, Artificial Sequence
  Bisulfite treated GSTPi after artificially methylated at Cp[AT]
aacaagagatcaatatctagaataaatggagatctgcaaatcaacagaaagtaggcagcaaagtcaaagaaaatagtctaaggcacagtcactaaaaggaatgtgatcatgttctttgcagggacatgggtggagctggaagttgttagtctcagcaaactcacacaggaacagaaaatcagtgagattgcatggtctcacttataagtgggagctgaacaatgagaacacatggtcacatggtggtgatcaacacacactggtgtctgttgagtggggtgctggggagggagagtatcaggaagaatagctaagggatactgggcttaatatctgggtgatgggatgatctgtacagcaaatcatcatggtgcacacatctatgtaacaaatctgcacattctgcacatgtatttcagaacttcaaataaaagttggatggtcaggtgtggtggctcatgtctgtaatttcagcactttgggaagttgaggtgtgcagatcatctaaggtcaggagtttgagatcagtttggtcaacatggtgaaattttgtctctactaaaaatacaaaaatcagtcagatgtggcatgcatctataatttcatctacttgggaggctgaagcagaattgcttgaatttgagaggtggaggttgcagtgagttgttgagattgtgtcactgcacttcagtctgggtcacagtgtgagactatgtcataaaataaaataaaataacacaaaataaaataaaataaaataaaataaaataaaataataaaataaaataaaataaaataaaataaaataaaataaagcaattttcttttctctaagtggtcttcatttctcttttctgttctgtgaagtgggtgtgcaagctttgggattgcagtggtcttagggaatttttttttgtgatgttttggtgtgtcagtttgctgtgcacactttgctgtggttctctttctgctgtctgtttactttctaggttttgctggggatctgggaaagagggaaaggcttttttggtcagctgtgtggtgactttggggacttcagggtgtttctctgtggttgatgtttggggtgcagtggttgttggggctggggttggtgggagtttgtgggattcttcagaagagtggttggtgttgtgactcagcactggggtggagtggggtgggatcattcttataaggcttggaggttgtgaggtctttgctggagttttgttgttgcagtctttgtcatcagtgagtatgtgtggtttgctttttggggatggggctcagagctttcagcatggggtcaatttgcagcatcaggtttgggcttttggcagggcttcttgttcatcttgagatttgggatgggggtctaggggattcaggatgttttcagtgttgttagtggctttcagggggtttggagtgtcttggggagggatgggattttgggggtggggagggggggcaggctgtgctcattgtgtcttggcattcttttttgggcttcagcaaacttttctttgtttgctgcagtgttgttctacattgtggtctatttttcagtttgaggtaggagcatgtgtctggcagggaagggaggcaggggctggggctgcagttcacagtttcttgttcatttggagagatttgaattttcttatttctttgttgtgtggcttttattttgggtcttctttctgttttttgtctcttttgtcatgtctgctttttgtttcagtgttgtgtgaaatctttggaggaatctgtttatctgttttctttctgcacttctgatttctttttgggttgctgtgaggtggagttggtttggttttcacatcttgtacttctttctttttgcaggttgctgtgtggttctgtgcatgctgctggcagatcagggtcagagctggaaggaggaggtggtgattgtggagatgtggcaggagggctcactcaaagtcttctgtgtaagtgatcatgtttgggcaaggggagggggtgctgggtcttagggggctgtgactaggattgggggatgttcaagctcagtgtttctttctgagtcatgtctttttcaacagctatatgggcagcttttcaagtttcaggatggagatctcattctgtatcagttcaatatcattctgtgtcatctgggttgcattcttggtgagtcttgaatcttcaagttcagggcaggcatgggcaagtctctgtttttggagttcttttgtttaaatcagctgttttgcagttctctggagtggaggaaactgagattcactgaggttatgtagtttgttcaaggtcaagtctgggtgtctgcaattcttgttctgtgtcaggctgtctttcaggtgtcaggtgagctctgagcatctgctgtgtggcagtctctcattctttcatgcacattctctttttcttctttcaggctggggctcacagacagttttctggttggttcattttcagtgactgtgtgttgatcaggtgttcagtcatgtggtctgcttttcttcattcaatttcagggctctatgggaaggatcagcaggaggcagttctggtggacatggtgaatgatggtgtggaggatctttgctgcaaatacatctttctcatctacatcaactatgtgagcatctgcatcagggttgggcactgggggctgaacaaagaaaggggcttcttgtgttctcatttttcttatttctcaggtggcttgggctgatttcttcttgggtcagggtgcaggggctgggtcagctctgggtcaggggttcaggggtctgggacaagacacaatctgcattcttattgtctgggacatcaatcagtcaagtaatgggtcatgggggtgagtgcaaggacagagatcttcagcaactggtggtttctgatcttctggggtggtgagggctttctggagtagtcagaggtggaggaggatttgttgtcagtttctggatggaggtgctggcacttttagctgaggaaaatatgcagacacagagcacatttggggatctgggatcagttcagcagaggcagtgtgtgtgtgtgtgtgtgtgtgtgtgtgtgtgtgtgtgtgtgtatgcttgcatttgtgttgggtgggtaaggagatagagatgggtgggcagtaggttcaggttttgaaggtcttgaattcactggtttggagtcttctaagggcaatgggggtcattgagaagtctgaacagggctgtgtctgaatgtgaggtctagaaggattcttcagagaagtcagctctaaagcttttgcaatcatctggtgagagaattcagcaaggatggacaggcagaatggaatagagatgagttggcagctgaagtggacaggatttggtactagtctggttgtggggagcaagcagaggagaatctgggactctggtgtctggtctggggcagatgggggtgtctcaggggctgggagggatgagagtaggatgatacatggtggtgtctggcaggaggtgggcaaggatgactatgtgaaggcactgtttgggcaactgaagtcttttgagattctgctgtttcagaatcagggaggcaagatcttcattgtgggagatcaggtgagcatctggtttcatgctgtttctttcttgtcattctctgctttcagatggacacaggtgtgagtcatttgtttagcaaagcagagcagatctaggggatgggcttaggttctctgttttcaatttcttcagtctgcttttgctggctgagtttctagtttttctgttctgcagatcttctttgctgactacaatctgctggacttgctgctgattcatgaggttctagtttctggctgtctggatgtgttttttctgctctcagcatatgtggggtgtctcagtgtttggttcaagctcaaggtctttctggtcttttctgagtatgtgaatcttttcatcaatggcaatgggaaacagtgagggttggggggactctgagtgggaggcagagtttgtctttctttcttcaggatcaataaaatttctaagagagctactatgagcactgtgttttctgggatggggcttaggggttctcagtcttgaggttggtgggagggcagagcagaggactagaaaacagcttcttcagcacagtcagtggctttctggagttctcagtctggctgtgtttactgaatctcacaaactagaagaggaagaaaaaaaaagagagagagaaacaaagagaaata

SEQ ID NO: 39 - DNA, 6343 bp, Artificial Sequence
  Bisulfite treated PITX2 A after artificially methylated at Cp[AT]
gattgtctattcttgtcatcagctgaaggcaaggttgttctgctatgagtgtctcttaatctctacaaaatgaaaagaaaaaaagggaggattattagttcattactcagaggaatggggaggctgcaaaaattgttgatgggcagaggtgaagatgtctttcttggactgcactttttggtgttctgtaactagagttcagttgtgggacttgttgaagaaatttgattttcttgtcttggtgagatttcaaaaatcagaaatagaaattctcagagtcagagaggaaatacaattaaacagcatgtgggcattttttttctcatttctcttttcttaaataacactgctttgagttttcactgggtaaagagagaaagtttgagttttcatggatgttatgtggaggttagaaatggcttaaaatgtagatctctaatcagttttctttgtggctgaagaggctaattcttttcataaaatgagttcatctgttgactgttagctatttcaaagtgaagggatttagcactcaaaacaaattgagcaagtttgtttgtctgtttttactgctaactcaaatgaattcaaaacatggagtaattcaagaaaacacataacatgtttcagacagttttcaaaagtagggaaagttcagcatctatatagtgactagggttagttttaagtgtcaagcttttttaaatgtatctattttatgcacattcttttgagtcactatatatttctaaaattgtgagtattggtatattgatttaggaagagcaatacaacttttagagggaactttattctcaattagggatcaaagagatgtctttttaatagtgggtctgagttttgctctcaagcaggaattaatattggtgggaaaatttgaattcaggagcaatggctgtgttttggcacttttcaaaaacatacattaacaggatgttcttgagattgaaaaaacattgtttcatatgtctggcagaagtcttcacatctggttcttcaggtgaattatatttatagttctttcactcagaggcaggacagagtcaaaatattctgctcactatcaaaatacacatctttgctcaagtcaagaaatcagaaaatcagggttcagaagtaaggcacactttttgagtgagaatatgttctgtaatttcacatactctttgctttgcaggagcaaatgtggacttgagggaaactctctttttcattttcacttctattttgtgcaatttaatatcattcttgtcaggaatcttaatcttgtcattttaaaaaatgagatatttgtgattcagggtgaacttgttgaatgtaggtacagcagaggaaattctagactctatgagtgtctgagtcttgttcagtgcaaattctttgtgaacactgggtcagtgtgtggttgtgttcatctgtgtgttgacactctcagcatgtctggttcatttgtcttgatcttgggtgtggtgtttcagctaagctgggttcagtgttttggtctttttcagctgacaagtctagcttgtttgcttttggctgtggttctttcattctctttcactagctcacttcattcttctagatttctcttcactcattctctttcattttcattgtgttcatcttcacttttgttctctattggtctctcacttttctttctttgcagtttctctttgctgtgatctcttttctcaactctgcaggtctgaaagaaggtcacacatgcatgctcacattcacacttcacatgtcttgtttcaaacaatttcatgaacattgttctttgttttgtctcttgggtcactttttctgttgctttctttcagtttgttctgatttgcttttcaaaagtatgtttctgtctttttgctgttctggtgctttttctttgatttattagggctgttgggttggtgcagattgctttttcttctctttcatttcattctttcttctggttcttcttttcacagtgggagtttgtgcttctgcttcttggttggcttctaagtgttttgtcaggttttctcttcttttgctcttttggctttggcttttgactctttggtttgctggcatctgcttttcttttctgtcttgtttcttgttgtttctgcttgctttttttggtgcttgtttgggtgctgtgcttgcttctggattgtcagttgtgcagtgggcttgttggtgtttgtgtgtcactgtgcagtggagtttggtggaatctctgctgatgtcatgtcacttttcacatggagtaggagcagagggaagagagagggatgagagggagggagaggagagagagtgtgagattgagtgagaaagctggagaggagcagaaagaaactgtcagtggtggctagattttggaggtttcagtgcatttgtggacttctttggaacttggcattctcaggagttctgcagttctctcaggtttggcttttgggtgcttgttgtgcagttggaggcttggcttgctggaaattgttttgggaagcagtgggatgtggagacagcagctctcttttggtagttggtaagtggaggtcatctattttgcagggatgtgagataatgtgagtctggaaatttgtttcactttggagaatcttcattgtaggtgatttgtggcttttggggctaagttttgttcaaggtaatgcagttggcaaacagatcttgcaaagttctgtttcttttgttttttgtcacagacactaacaatctacagggtgctgaagttgagagggaagtcagattgtggctggcatttaaaatgaggtatcttttcttaaatcttggtgtcaacactgcaggaacaaattcttgggtcaaggattagcattctcaagataaagggctgggtacaaagtttcagctactggaagattagttttcttttcattgttattcattgggaaaaaaaagaaaagaaaaagatttcatcttaactggcagttagtgatctctcaggttcaagtgaattatctgggagtcaggtctggatgtcaagctctcatcatttctttggattgtaacttctttaaattgatcatcagtcaacttcaatctggcacttcaggagatacactttaaatggatgcagagaattatttttcagctggagattaagaaaaaaatttttgattctaaatctttgaaatatgtttctctttttcagtttaatcactttactttcttaagcaatttagaaatcaaactatcataaggtggtgtgatttttttttactcttttgtgtgagtattgtcttactaaactaaatggaaaaaacttttatcattataaatgtaaatatcagaattcatacattctaaaatatttttatgaaaaattaatctgatttaaagaaattttcttgcatttgttttagtctatcaatcaaaactaaagatgcttttatcacacaaaatatcattttggcagaaattcatctaaaattcaaatatcaataatatcaagaaaacaaagcacataagcaaaataaattgaagatttttgttgatgtaacatgagcatacaacatttcaataatcaaactttttctaaaaaattaaatagtcacttcatttgtggaatgttttactttaactcagcaaaattacacttaaattatttaggtgctttgtttcttaagttaagtgtgtttgtcttcaaatgtttctaaagcacttatattaattggttgtaaagaatgcatacacatggtaaaatacagaactgaactgagcagtattttaattttcttaaataattacttactacaaattaatttactggctaatttcacaatttagttcatttaaaacacatgtttctgtgctgtttatttttaaacttttcattaaagattttgttatggggtaacaaagtgtatgaaaaggggggaaatgtgaaaggatctgggattatttgaactgtattttttctgcactttcagtcttgtggtagtcatcagaaattattttttagcaaattgttttatttcttagggcttgtctgtctgctttgtcatggtttcttgttctttgttagttgtgtagtgctttttgtgtgctcacaatataaaattcaagttggtcaaaacaagagttcttggcatatacatttcaactagaacatgaactttgggggtgagaactatctttcatcaggaaaagtctttcatctcaatttgtgagattagtcattgaagtcagttttgaagtctggcagtcaaatttctcacagaagacttgtcttgatagggcaagtttaaggatcagcaggtgggaattggaggtctctttttaaaaaattatctttttcagttatttagactcagttcttctagtaggtctggtcattaaatgaagcataaaaatgcaagtctcaaggctcattttgactgcaaaataaatcttcaagtcacaaggacatgtaggagtgagctaaggaacatgtcttgatcttcttttcagttcttagagtggagctctatgagttcttgaagatttgttttgtattgctttgtttggtcttcagcactgaagcatggggaagtggggggaagaatgtgtaataattgactgactttacatcaagcaatgcaatctttttcttttgtatatttcattctttaaaaaaaataaataaataaaaactatttgcagttatcatctgcagtgctttggctatcagctaataatgcagtcagttcagacatataaaaaaaaaagattattgaaatgatgatgacatgcaaattttctttgaaattatcataagtaaacatttgaagtctggactaataaaatttcatctgtgttacttcatattgagttagtagaaagctgtgataatgaattttgtaatatctcatgaacagacatctcaatcagggactaattctgtgattttactgcagaatcactaaatctggagttgtcaaactgctacttctgggttcatgggttcacaaggattgaattggcagagtttttgtttgtgttcttgctagtgggtgggggaattgtctggttgttttcattctggattttcatgtcacagtgttgggcagtttcttctgtaggcagtgatcttggtcagaggcttttcagggttcagctttcttcaggagaggttgagatgcagggaaatggtactcaggtcagaggcaggtttgcagctttctgttttgtctctgtgtctttgtcaatttgacaatgcttgctttcattttgatttttgcatttgtgtgaagtgggttctttggttgttggtgtattctggttagtgtggagagaggcaggtgctgagattgaaggggtctagggagttctggatcttcttttcttgtctttaaagcaattgtggctcttctattcatttggtggagtttcttgagattcatctcttttggcttgtctgtggcagagaagggggagtgtgttaaatgcttggcttgctgtgttgtggttgaaaatgtgaaaaagatttggcttgtttgggagagaaagggggagaactgggtagcagttatatcagagctatttctttgttcttggtgggcagtaaattcttcaagaatgtttgttctgctcttctcagtcttgctcagttcattcagtgtctcttctctgtgatcttaaatcatactttagggtaattatttgtagtaagtaaataaatggttgggttagtatctctaggagaaagtgtggctaaatatggaaaagtggcttctgatggatgagaggtttgaactcagcttgcttctgaaacattctaggtcaagagtttgtttgtttcagaattacagaaaattgagggaaactgctgtctaggacaggggcatgttggtgctgatgttctacaaatgtttattgagcttcaactaatggacaagcactgaagggtggtctttgcatacagcttttcaaagagaaaagttctcttcattcattcacttttgctgtcattgtgttcagatgagttcttaattttggcattgagattcttgaaagtaggttcacagtcttttcagcacactgtggctttatagttctctaatctctgggcacttttgtggcaactctggagggagattttctcttgataaataaatgttctgggtttgaggctaggctggagatgctgctgcacatgtcagaggctgtcaggttggaaaaacatgtctgaagtctagcacacagtaggtgtctaacagctagtgtaatgtagtctcatctgagttctgctcacttgatggttgttgcttcttacagtctttcttctcttctgttttgcaga

SEQ ID NO: 40 - DNA, 9001 bp, Artificial Sequence
  Bisulfite treated PITX2 B after artificially methylated at Cp[AT]
agctgatggacttgctaaatttctttcttcttttttctttttcatattatttgctagtcataatggaattctctaggtttaagtcaaagaaaaattggagagacaaaattagattttgtagttctttttttttttgggaatgtctttttttttctttttagtttctgatgaatggctatcatttatttctatcaaatttaaataaggactgctgtcttgtatgtttaactaggcaggcagagggaactggtttgtttaggaagcagtgactgagatgttctggtcaagttagtgacagaggaggggagaaagaattcagatcaatttgtatgcagtatattttactttcatgaaataaaacacatttgtttcatatttgctgaaaagtaaaacaataatattgtatgaaatgttatacacagggtaggttgtacatagcagtttcagaaacatcattgcattcatcagagaaactattctaaaactgatattcacacattttttataataataataatatgttagaaacatacagtgtggcatttagtatatacactttcttgcttgcaagtgaaaaattctaattgcttctgtataacatgctttattttaaagtctaatctttaaaaacactgttgtgatattactaacaactgcttttataaaattaatttgacattttgatatatatacattctttcagtcatttaaatgttaacaatgctaaacttaaaaaataacaagcttatagtaatgttaaaatgtcatattcagtcaaacatttgtttgtgtatgtgttcttgcaactgttagaaatacttgtagtgaaagatgtcagacactgaggacatttctttgaaatcaaaggagctctctctttgattcagtggttttcttttctctatatagcttctctttctctttctttctttagtgttcatgatcttctagcataattttcagtctttcaagggtggagttgtttcatttggcaaggttctaggattttggtgctgtgggtgtggctcacatgggttggttcactgcatactggcaagcactcaggttggaggttgggttctgcatgctggtgtagttgaagctggagtgctgctttgctttcagtctcaggctggtcaggcttgagttacatgtgtttctataaacatatggaggagttggtggtgtgtaaggacaggcaggtgttggcattgtggaattcagtgatgggctactcaggttgttcaagttattcaggctgttgagactggagtttgggatgtctgtcactgctgagggcatcatgctggatgacatgctcatggatgagatagagttgggtggggaaaacatgctctgtgatgacagggggttgatgttcatagagttgaagaaggggaagctcttggtggatagggaggtggatgtaaggttcttggtggttcagttgttgtaggaatagtctgggtacatgttgttgtagggctgcatgagttcattgaactgtggtttgaagtcattcttgcatagcttggtctgctggttgtgctttctctttcttcatttggtttgatgattcttgaatcaaatctgggggtggttggggcaagggagcaaacagatgtcacagtgcagattactaaaactttcattggaggtcaatttttgtctttttttgacacacatgctagtgcactcacacattctggtcttgcttcactgcattgttctgcacatcaagatatcagggtcagctttcagttactggtttgggtcttcatcaagtgcaggagatctggtctgctctggtctgtgagctgggacttggagctatgtcacaaatctcagttgaatgcatggagatctgtggatggtttgatcactcagtcaggtgtttcttcaggttcaaaaacacttaatgtaaaacaaatgtggggcagcaggctttttcaattctttttggggcatcttgcaaacttgctttcatttcaaagtcacagattcatggatgaggagaaggggctggaagggcactagaggattgctctttctttcatgcaatttctttctttcttttctgatcttcactgttgtttttcattttctggtatgtgctttcttaacagggactaggttgtcaacactctttcttgtctagcaaaacaatcaaataaagagcaaaagatcatctctttgtcagcttgttaacttcaggagcttggcatattaaactttgggaatttggaaagggtagttttggagattttttcttcttttgctctgtctcttctttattctaagttcatcacaggtctgtttgtgtgtcaggttcagttgggttgtttggctttgcaggtggtcattcaggttggttggctttcatttgtgtttggtggttcagttgcaattttgatttcaattcacattgggtctttctgttgtttcagatggtggcttttgtgtattggagagaggtctggtctgagatatttgagctgacatcagtgatgtttcacattacacatctttgttgggttcagttgtgtaatttgctttttctcttttttctttcattcttgattttctttttatttttctttctctttgcatttgactgctataaaaagcatgtctcactttcacttggcttgacaagcagttgttctggaaggagaggcagctgcaaggagagttcagtgttgtggctacaaagcactagggtggagctgtggaatagtgggtggggtgggagggtgtttttgaaggatttcagaaaattcatagactctgtctttaattacttgtcatttctattctaggtcatctaaactttgctcaggtgagaagagtatgtgagaggtttgttttcttgatgtgcaagagagctaatgaaagactgatcttgctcaaaatcatgttgttcaggattcagctctggctctggacagttaaactaaaatcattttcaacttctttttggtcttttattcatcagcatagtctcatgtcttgcacaaatgtcattcagagagtgtcttcattttctctgatttgggagagcattttggtctttattctttttattgttgttttcttctttttgtttgctctgctctaattgggggctttattttttctattcagagcacttaattttttttttttaacagcaaagtctctggatgttgcttgatttgcttgattctgttttctgctttcagaattctaacaaatttggaatctttcattgatcagcataaatcaggatgttgctattgggttatttatttgagctcatttttgtcaattcataaagtacagatttgctacaaagttaaggtaagttctttttacaaaactatgattataatttagaagagggggtgtgagtttcaattttcagagttcaacttctgagagaagataaataaatcaagcagaaaagtctttcttctttttttctttcttcttctaagaggactagtagttgtgtattaaaactttgcttttggagatcacaaaactaggaaatagggtgtgtgggagagatctgaatggttgaaacaattgtaaagaaggtgtaagaagtgtgagttcaggagggaaaaagctgggtcagggttgggacaaaggtttttcagggagggtcaactcttttgtgtctctggtgggtttttcttgttaaaggctcacaggttggagtctgtttgtggctcttggtctggtagggattttattagctctgctctggcaactgcaagtcaggaacacaatgttctgtgcaggggattgttcatgcagttcagcttgtgagattgtgggatggtggggcagtgagttggtgttgctctgggagtctgagtcagggtggcagttctgttggtcttggagagggaactgtaatcttgcaatcaggttgttgtgaggtcttctgtctttgcaaagctgtgtttcattggtgttctttcaggtggtgctgtctttcacattctcttctggtctacttggtctgtatcttcacaacattcttttttcatttctttcagactttgtgctggcttctatttggacttgggcttttgtaaggttggttcacacagtgatttctttgtgtgtggacatgtttgggtagtggtttctctggaaagtggtcttcagcttctggagctgctggctggtaaagtgagtttgctgttgtctttgttgcttcttcttagatgggttcttggtgttcatgttctcattctttttctgctggcttttatctttctctgaaaatgaaacacacacacttttttgtcagcatgttcatctgcaatgtggatgtcaactggattggtggcagaagttgtggaagagctgggctgtctggtgttggaggagggtgtgtgtggtggctttgggttgtgaggagtgctgtgtctgtggggtgtgcaggtgcaagtgtgggtgtttgtgtttcattttcttttctttttcagtgttgcatgttttatttacatgtttatctcactgcagtggcacattcacttttatagtctgtgctttcaagtatatttatacatctctgtgcagacacatcaaatcttctgggatgtgcacatgtgtgtggtttacagatttttctttttcttgcagaaagctcagattttcatgtggtttgggaaggctaggaaaagatgtggggatttggttgggcattgaagtttgttggttctttttcaaaaaaaaaaaaaaaatgtctctttgtgaagggcatttctgagtggtttcaggcaattttctaatgagtggagcttcttgggagctgaaagttgagaggaaaacagggacagaggttggtggtctctgaaggttcttgaatcaagatgctgggatttttgtgattcaggaaacagaagggaggtcagggtatgaatagagagggtggcagaattgcttgtgttcttagtgtttcaggagttgggttggttgagggagaactaaagggatgtggggtagtcaaaattttggcttttggaagttctgtggggagtcaggtgaatgatcactttcatcatgtctttttttggaggggctgactttcttggggtgagagggagtgggtggtgcagagcagctgagtgggaatgtctgcagggtggtgtggtgtcttatctgtggtctttgggctggaggtgttggagatggtgtgcatcttcagtctgtgcttggaggagttcagtgattggggctgattgggagtcagaattgaagtcatggctaatggctggggatggtgacaggaagatgaggagatggttgacagcttggtttttgctgcttggtgcttcaagtgaagtgggtctttcatgcagttcatggatgagggagtgtgatgctctactagttcttggctactgttttgttgagtttttgtagttgttgctgtttgctttgggttgtgctctaggtgtggagtttttttgctgtggggagagtcaggggatgcaatttttgttgagttctcaagtcaagctgtttttgtcttctttggaaggctcaagtgaaaaagtttggagatggaaagtcagtgggcaaatgaagacatgggatgtgggcagaagggcatcactcagagtgtctttagggagcaggctttcaagcttcaaagtgaaacaagagtgggcaaagattttcttcttctctttctttctttttcaagaatttcttcaataaggaaagctaatgttgattgtgctctgtttgtttttttttcatgtggcagttctgacagagaagtgtcaagagtgacagggacaggtaggtgatattagattttctgtggtggcagcagttgctgcagtcatgatgtggttctctgagtgcattctttgcaatgtgcacatgcacatttcttgggtggttgaacaggagttgggtcttgttgcagctcagcttcaggcattcaggtgagtgatggatcagatctgtggctttgtgcttttctgttggtctaacatcttaaaatcagaggtgggctttctggtgttgagatgtcactttgttgtggttcttttcagttctctttgtctttgtcttctttcagattcttctttgggtgtgactgatgtggctttgcatcaatcaggatgttttgagttgtggtggagggactgttctgtctgcatctatcagcagtgtggggttgggctactgtcttgttgtgtgcactgggtctacacaggcaagcttttgggaattcagcttctgttcagttcaaggtgatttggcttttagtatgaattcaaaggtgaagagatgaggctaggagttgaaggcttgggagaagagagtggaatggtcaagaagagaaaggtacaaggatcaacaagacattcactctttgtgtctcactacattcattttcaatttttcatttcatataaaaaggagacatgttacttaaaactagaaaatttgaaaaacagcaacaaatcatctctttgatcttaaatttttcaaacagtctgtcaagtgaatgctgtgctaatctgaagaagctttaattgcaaagaagacagagttctgaaaaggcaggctaataaattagaaattgagaagcaaatggatttgtcaaaagaaaattatcttgactttaaatgaacaactgtttggtggttcactctggatttatacaagaataaaaagttgtctcagatcatgttctctgtgatgcttattagttttcagacagaaaacacacaatagaagagaaattctaattcagtgttttcaaaatgctgaaagcttattcattctacttaatgttgattaagacacatattctagatctttcaaatttcttgtacactgtattaagcttgttctaatttgagagagtcatgctttaaatttgactctcttgtttactttattatcaatcagatttaaattcataaagtctgtagaatcaacaatcttgagctaattatatatgaaatatgtcttaatgaattttcatacaattaagaatgttgtcaaataatcaatttcaaggataatttttaacagtcattttcttttttcagtgagctcaaggctgtcttgagtcattaaagttcaagcaggcagaaggggtgtgtgtgagctaagggtgaaaagtctagaactgtgctcaactagcaaaagcaaaatcttatttatataaaacaaaaaaaatcatctttggagacatcaactctttatagcactgttttcaagcaaatttaattttcaaagaaattaaagaaagaaattcaaacatattcaaaataatttttgaaagttcttttgtttttcagcataggtcagctggagaggacaaactaatcttctctgggtttctgcatgggtgattgttttactatggagttagtgttatcatctctgaatgtgtatttgtttgacattacagtcaatgatttgcaatgtcagcatgaagtatctttaaaacactttcttcttgttcttgttcacaagattgggaaacttatttgatgtggaacaaagtggatgaagcagactacaaatatatttgcaacttatgtgtctcttctttgttctgatcattttcaaattctatctgcaacttcttttcattttaaacttgcagttcaaagatgcacatgagaattgtttttcagtctttcttcatcagtatcatttcactttaagaataatttagctgcaagggaggaatttcttcatagtaagctttaaatcagcatttctgcttttaatcttttatttcactttatttcatttcacacatacagacatctgctcagagtaaaacacattctcatgtgacaggtctgcattagctgaggctcatacattcagctatattaggttctgcaatcttatcactaaattatacacattacactagcagtctgttggtaaagaaggttaaattaatttacattctgctcattatctggtgcttaaatgatgcattttattttggagatttggtggagaatcttcttctcagatttcacagtgtttcactgaagacaatgctcttacatttgtagtggtttttaatctgataagactctaatttgcttaagtcttttaaataagggttttaaatgtttctagttgttttcttattgaattttctctaattttttcaagatcataaagtatatgtgtaaagtaaatattttctttcattgcactgtcagttgatgatctataactaagtcaataagaattcagctcttttctgctgaatgtgtttactaatcatatttcagtttcttcttttaaatctcagaatagctgtggttttcacaatatcatgtttcttaaagcttcatttcatgaagggacttcatcacattaaagaatgaaaaaaatcttcactgtagttagtatacacagtttctcacttcttgtttttcaagattcaaatttcagagctgcaaatatttttggaagcttgggtgttaatgtcttattttagaaagttgagaagtttcacagagtcatatagatttctaaattcatctctcataaattcacagaattttgataaaagctctggtggcttcactctattgatggaactttcatcatgacaaatatacatgtatgaaggatctcaatcagtcttcaaagtggttgaaaaattcaagggcatgtgactgcttctcatagtgtcaatgtgtgtgagatgttggaagcactggggatcagcagcagtctagatgtctaaaaagataaggtgttctaatttgtgtggattcattgaagtcaagtggtgaataaagacaattatctagataattcagattaaagtaaaagcaaaatcatatctatttgtatatatatattcacattcattttatattacagacacacacatgcacacacacactggctctgtaaacaactgactcaaagtgaggattttctttgcattttttcagcaggagtttcaacattcttctaatcttctaatcactttaca

SEQ ID NO: 41 - DNA, 1920 bp, Artificial Sequence
  Bisulfite treated RASSF2A after artificially methylated at Cp[AT]
tcaggctgttgtagacacagtctttgctcttttgaaaaacatgttctaggtgttgggatttcagatatctgggaaatagagtgcatgcagctgttgagaggtcttgtgcttggcttcttctatcactgaggtgcagaggtgctgtggacagttcagattcacatggtgtttgaggtgaaacagaattctcagtctttctatgaggtcactggcactcttggctgttttcagagctctttgacttagagctgaatgcaaagtaagtgcttgaaatgcagaagtagttggggttgttcatggcatctgtcttgcttggggtgagagaagatgtcaggctgaggtttcagtgatctcaggcatcagctttgaaggagggtggggagattgcaaaggggaagtgtttggagggtcaatggtttttgtgcattctgtgtttctctgaagtgtgttgtctttttgtgttggggactgggatctgtctctggggaatttgtctagaagatggtggtggactggggttgggcactcttcagggctgtcaggttcttttcagttctgcatctgttgtgttgtttcatcttgtcaggaagtctcagagattttggggatggggtgggagtgtcttttcattgtgggctcaaaaagaaggaaggatgttttcaggggttgtagaaggaggactagcttcaagtcacaactttctttggattcaaggcaggttggctggggctttgtgtctacatggtttctggtgggggtttgtgtgttttgggagttttgtggcttggggaggaaagaggagacaagagacaggtgaggattatggggctgattcagttggggtagggatcattgtggaaaaactttggtgaggtggggggatgtggaaagagagtggtttgtgttctgcatcttgtgttgggcattttgtgtcagtgtcttgctttcagtgttttgtgttttgtgttttgtgtcttgtcttcattttgggtcagctgcattgtgtttgtgttgcaggaattgtggagttggaaagtgggggtgttgtggctggggggctgcttcagctgtgtcttggtcagtgattggtgggttgggctcaaattcagtcaggctgggcaggtggtggttgtgtgactggggattgggtgttttgttcttcttgcttttcttcttctttctctttctttcttcagtttcttggtctttttcagtttctattggatctgcttgtttgctgttctctcttttctcttgctcttcatatcactcttcatttctttgtcttgtctttgtctttctttcttttcttgtcttctgttttcttctcttcttttcttttctctaggggtggagcttcttttctttctttcagacaatgctgtggctgtgttttcttttttgtcagcttgttcaggcttttgttgtcagtgattcttttgggctgggggtggggaggtggggggggagtgcagggttggggaggatgagctggcttttctcatcttcttgctgctgttctcttcaagagggatggagacttggttcaagcttcttggttcatttggagctgtgacagtcactttcagggaacagtcatgctgttctatcaagttcatcttcagtggtctggatttttcaggcagaggttgtgggattttgttttttctaacatttcagcttattttcaaaagggtttgagttggacaggggctaaacaggtttctttgacttggtgggttggtcagatgtgacagcaatgtcaaggaggtcaagtttctttgttcatttctcatctttttctttttcatttctggatcttctggtgttttcagtacacagaggttcttgagcagtttggctgcaggttttctatctactcagagttctttttctcatgtgtctattttcaattctgca

SEQ ID NO: 42 - DNA, 5473 bp, Artificial Sequence
  Bisulfite treated SHOX2 after artificially methylated at Cp[AT]
gtaatgttaattagcttcatcttaaagaaaaatcaaacatcagagcaaataatgacttctttgtggagaaggagttgtaagggttggggagaggtaattagtgtcataaaagtctcactacaaagaagtttagaatttctctgttctgctgtgcagcagagtgaaacacagtagcagaataattgtgcatcattatcatgataatctaatttgcttctttagaaaaagtcactgtttgcagttaggatagtaggaaaacatctagaaaataactaaaatgtaaataaaagtatgaaacaacaataaagttcacttcttaagagaaaaaaagaagagcactcagtgaaaggagaatgaagtatatataaagcaagtaactcttaggtactttgttcttctggatgttatctgcttaaacttgacaacttttacaggcagtatgacagattttttaaaattcaaataaagcttgcttttgtatttcactttcaataataaagcatattgattgactcacaaattaaagtttttaaaatttcattaaagtaaaaatactgcttcagagctttcattggtatgtttttgaaagcaagtgtcatagtcaatgtaaatcttcaaaaatttctctgctatttagtacaacagagggtggattttgtgtcagggtggcattctttgtgtaattcacatggtctgaggcttcttgtcttttttttttctagaagagttggaattaagatactaataatcataactgtaataattatcatcatgtttttaaggggttgctgagtctctggagatctcagtgcacagagtgaagcaggagaggcttaaaaaggaaggctctgctgctgatgctgtgatgatcaaggcagtctattattactttttctcttcaatgtgactgctctgttttttttttttctgattctgttacaagatgtggggaagtttcttaagaattgtgcatagtttgctacagatggtggtctctgtgttcagagattgaaagagtatctgttacagtgatactttgtaacagctgcagatgtgtgggtctaaaactgcttcatgtgttcaaatcaataataactatcattttattctattttattatctgagtggaaatacaatctgaaacatttaaatttgttttttctaaagctagaaggatatgtgtatgtgaatgtacacaatttgcttctttaaatgttttcaaagtctatttttgctattacatttgtcttcacaatcaataaagaaaatctgtttcagttctaacttcattgggtatggcatgtgctggagggcaggctttggaaatataaatactaatatatgtggtttgttttaaaatctaatgtatttagggtcagttttgttgtcttggttaaatgaatgaacaaagagtgatcaaaatgtgtttatttctttgctatttcacacacagtttgagattgattgctaacagcagactgtaaatttctgcacttaacagttactaattttctttatagtctgcacatctataaatctaattgggatatttgcttgacaaatctagattctgcagagcagactttcaaggaaattcaacttcagagaacaaaatactctttggaacttttaaggcattcagagataaaatgttttctgtgggatttttttttaagtcttataaaagtaggttcattaggattaaatcacattaaagtcagtgtgaggcaaggggggtgtggtttatagaaactctgggagaaagttcagcacagctttcttcttctgggaacatatgttaggatggaaaaaaaaaaaaggaggggagtgctataggactaagatctactttggaaaataagatctctagtaaagatatctcttttcttctcatcttacatcagacactagaagcatcatcttttgagtgtgtttttcaagtctcttttcaatttcaggctctctctgctttctgggttcttgatcttctggcagctgggtatctgcacttgggtctttgacaggttcagttgctggctcagtttctcttgcatgaaggtgttgggatagtgggtcttgtcaaaaagtctcttcagctcattgagttgtttcagggtgaaattggtttgactttgtctctgcttgattttggtctggtctttgttcttcatttcttttgcattctctttgtgatctttcagctttggggacactggagggggcatttcagtggggtcacatgtgcattcacatgaacacacacacacatgcacacacacatggatgaaaacagcacagcaaattctgttatcagatttgttgcaaaaaagaatagagaattcttttttcttgtggaattctggtttggcttctcaattcatttggaggaagaatattttggagaagtgcaaaggtcaagtctgagtggttgtctggggcaaggtgggcagtcattcatcatcttcttcacaaatgtatcttgactcattgtctcactattcatttttcagtcattggtctttttcagcaaacatcaaatggttttcactcacttttgcactcacttgctttgcagcactcacagaaatcaaaggtgcagtgtcaggtctctcacagagcaaagtctggacataagggtgtggcaaggtcattcactggtctctcacattggtcattttcagaaggctggcttgttctcaggtcagctctcatcattgctggctctctgtctattgcaaacttgctggtctaatttaggaacaattgggttgaaaggtatcagtgagagcaacagattttggtgttgtgttgcacagggagttgcatttgcagatgtttcttgctgtttctgggcttgggtcaaattctgcataaggttttctggacagtcaggtaatctttgttttgtctgtttgattggggttgcatgagcacaggtgttcatgtcatgttggctgttcaaagggcttgttgttcaagttgggtcagaaggcaggaggtggaaaatcagtctttggtggtgggtgaaagcaattgctctttctgttctctctttgttctttcttgtggaaatgcagacttgattctaaatgcttaattcacagagatcaacaggttcaagtggaatatttgtgattcttggtttctattggttgctcaaagtcttttcatgcaatcagcagcttggatgtttaataaaatatgaatttttctgctctgggtttgcacacatttgttgtcacttttctgttcttcttctttctttaaaaacaggagctcttctagtgtgagcatatacagtcatcatatatatatttttctggaatctttattctctgtgtttgaatcagagactttgggttttaagaagtcaaagctgagtttagatagttgaggctgtttgcagttcttttcagtgcaggattcaggtcagcatgggtgttaaaaatcatttttggaagagttggtctgcagagaaattaatacttgttctgagcttggaaatcaacaatttcaggaactgtgtttgttgggggttcagatctgaatcttgttgtcaggtgtgctggtgaatctgtagtttgggtctgtagttgtggactcatggttgggaggctgcactgggcatcttgatggtaacttcatcactttacaaatttaggaagatctggtgctggtttggaggaagaagagttgctagatcttggttctgttgggcattctagctatggtgatcttaaatattgttgtattttctagttctcagagttagttttgtggacatttgttctttctttaggaaggaacattatagtaaacattatgggtcaatttaatagcaaagtatttttactgatattgtattgaaatttaaatatgaaaacacattcttcaaattctgtcaatgaggtgggaaggctttgtctattacatgtcatctacacagtggatgtcactcaaagttttggggctttgaggagatgttcaaatttcaagttgattcatagacttaataaaatctctatttttgttttcaaattttcaattactgatctaaacaggaacagattgtgtcataaacaacttaattgcttgcttaaatatgtgatttcatgcatgtcacatattttcttaattggaaaaatatggcagtacatcagttactgcaggcatcaagtgtcaaatcaattttattgttgaacttctttgaattggtatagaatgctctgtcattgagataaagatgttttctaacactgagctagcatcaaaggatttttgctctaagagaattgagtactgggtgattgaaaacactaaaggaattgtgtaaatatagattttcatcttttttgttgttttttttttttgttttcaacacatcaagaaattgaaatgtcttgtttgggagaagcagtgtagtctggatctcagcttttgttggctttcttctatcttgaaagagaatgggaagttttggtttctaagattcaaagattcaggggctctgtggagtttgaggggtcttggtggtttcaaacatctaggtgattggagggttaagcttttcatctctgtttcttctttcttttggcaaactctgtgctagaggctagctttagttttgttgtctggttcagcattttcttctgcagtttggttttgtgaactttcatgtttgtctgtgggtcatttgggctgtgggttcattcttttgctggtgaaaaatgcattttggtggaatgggaacatctgggaagggtgtgcacaaatttcacatgctttttttcatgtcattttcacaacacactaggatttcattcatgattgagcatatcattggattttcattctttcactatcactctagctgacaaagctggggttcagggttctctttgtgtttctcttttctttttgctgggtcttggagttctcttttgtttgagaggagtttggaaggtgggaaggggaattgctgttgggggtcagtcaggttgttattctttgtcagttgtgggctgtttggctttctgcttctcttggtggtgttcatgttcagcttttggatgggagagtgttcttcttcagcttctttgtctgcttcttcttcttctacatcttctttgtcttctttgttgttgtctttgtcttctttgttgttgtctttgttggttgtttggactgttgggctgctgtggttgttgtggtttgtcttggtgcagttggttggcttcttggttttgtgcagtggtttgctcttcagcatcttttggtatgtgattgtcttcttcttcttcttcactttctggtcaaaagacttggagatgaatgttgtaagttctttcattgttgttgcatgtcagtttggtgctcaatctctgtcagcagagttttgctcttttttttcttcttctttttttactgcttcagttttttcaataataacacatcaatgggacaggaggtgggg

SEQ ID NO: 43 - DNA, 1405 bp, Artificial Sequence
  Bisulfite treated Septin9 A after artificially treated at ggcC, agCt, Ccgg
tgttatttgagttgtaaagggtggttttttgtgtttgttttgttgtattgatatattgagctgtgtatggtgtttagtgtagggagaataaatgattatttgtttaatgtgtttatttataggtgaggaaattaaggttttaatttaattgatgtattttgtttttttgattattagaaaagtagtaggataggtgttttgttttgttttattctggtctattaagctggtattctggttttgatttctggttgtgtctggtgttgttgtggtgtctggtgttgttgttttgtctggtggggtcgtctggagtgtttgtatttttgtttgtttttatttggccgggtctgttttgtctggatttgggattgggaagtgtggtgatttctggaattagttattggtgttagtgtggggagctgggggtgtagagctgtgggtgtggtgggtcatgtaggtggtctttatttctggtctggtctggtttggtttggtttgtgttgttgtgtgggggtgtttttttttaggtctggtgtttgttagttttgttttgttaggtgtagtgtagtgtaggggtgggtgggggtggggtttggtgtgtatgtttatggggtggggagggggtgggttaggggtgggattatagctggttgggccggggttttatgtgtatttctggggaggggtggggtgggggtggggccggggtggggtctggttggtgtattttagatggtgggtcgttttttttttttgtttttttattactggtctaggattagtgttttgggagtgtgtgttttgttgttttgttgttatatttttttgggagtggtggtcatggaggtattatgaagaagttttatttaggtgggttttgtgtctggggtggggaggggttggtgttctgggattagtgttgtttatttgagtgtttgtggccgggagtggtgaggtgtttctggagctgagtgagtttttgtggtgggtatattgtaggttgagttttttttaggatagggtcgttgttgggtcgtttttgatttgagttgattgttttttgtgttgtttttagtttttgtttgagtgttggaggggttgttttgggggatgtttttttttttttgttttttgtatttttgtaggaattgttgattttttaggttggccgggtgttttgggtttttgtgtgtttgtgtgggtgaatggggttggggttaggtggaggggtgtttttgggtttagtttttagggttggtggtttaggtcgtagtattttttttttggattttttttggttttttttttatttagtggggtatgggatggtctttagatgggattgtttagtagtgtttaaatttggtgatttgggtttatgttttgtgtttaggatgttgtttgt

SEQ ID NO: 44 - DNA, 2365 bp, Artificial Sequence; identical to SEQ ID NO: 16
  Bisulfite treated of artificially treated Q9HC74 at ggcC, agCt, Ccgg

SEQ ID NO: 45 - DNA, 4261 bp, Artificial Sequence
  Bisulfite treated GSTPi after artificially treated at ggcC, agCt, Ccgg
aataagagattaatatttagaataaatggagatttgtaaattaatagaaagtaggtagtaaagttaaagaaaatagtttaaggtatagttattaaaaggaatgtgattatgttttttgtagggatatgggtggagctggaagttgttagttttagtaaatttatataggaatagaaaattagtgagattgtatggttttatttataagtgggagctgaataatgagaatatatggttatatggtggtgattaatatatattggtgtttgttgagtggggtgttggggagggagagtattaggaagaatagctaagggatattgggtttaatatttgggtgatgggatgatttgtatagtaaattattatggtgtatatatttatgtaataaatttgtatattttgtatatgtattttagaattttaaataaaagttggatggtcaggtgtggtggtttatgtttgtaattttagtattttgggaagttgaggtgtgtagattatttaaggttaggagtttgagattagtctggtcaatatggtgaaattttgtttttattaaaaatataaaaattagttagatgtggtatgtatttataattttatttatttgggaggttgaagtagaattgtttgaatttgagaggtggaggttgtagtgagttgttgagattgtgttattgtattttagtttgggtcatagtgtgagattatgttataaaataaaataaaataatataaaataaaataaaataaaataaaataaaataaaataataaaataaaataaaataaaataaaataaaataaaataaagtaatttttttttttttaagtggtctttattttttttttttgttttgtgaagtgggtgtgtaagctctgggattgtagtggttttagggaatttttttttgtgatgttctggtgtgttagtttgttgtgtatattttgttgtggttttttttttgttgtttgtttattttttaggtcttgttggggatttgggaaagagggaaaggtttttctggtcagctgtgtggtgattctggggattttagggtgtttttttgtggtcgatgtctggggtgtagtggtcgctggggttggggccggtgggagtttgtgggattttttagaagagtggccggtgttgtgatttagtattggggtggagtggggtgggattatttttataaggtttggaggtcgtgaggtctttgttggagttttgttgttgtagtttttgttattagtgagtatgtgtggtctgttttctggggatggggtttagagcttttagtatggggtcaatttgtagtattaggtctgggtttctggtagggttttttgtttattttgagatctgggatgggggtctaggggatttaggatgtttttagtgttgttagtggtttttagggggtctggagtgttttggggagggatgggattctgggggtggggagggggggtaggttgtgtttattgtgttttggtatttttttctgggttttagtaaatttttttttgtttgttgtagtgttgttttatattgtggtttattttttagtttgaggtaggagtatgtgtttggtagggaagggaggtaggggttggggttgtagtttatagttttttgtttatctggagagatttgaatttttttatttttttgttgtgtggtttttattctgggtcttttttttgttttttgttttttttgttatgtttgttttttgttttagtgttgtgtgaaatttttggaggaatttgtttatttgttttttttttgtatttttgatttttttctgggttgttgtgaggtggagttggtctggtttttatattttgtatttttttttttttgtaggtcgttgtgtggtcttgtgtatgttgttggtagattagggtcagagctggaaggaggaggtggtgattgtggagatgtggtaggagggtttatttaaagttttttgtgtaagtgattatgtctgggtaaggggagggggtgttgggtcttagggggttgtgattaggattgggggatgtttaagcttagtgtttttttttgagttatgttttttttaatagctatatgggtagctttttaagttttaggatggagattttattttgtattagtttaatattattttgtgttatttgggtcgtatttttggtgagttttgaatttttaagtttagggtaggtatgggtaagtttttgtttctggagtttttttgtttaaattagctgttttgtagttttttggagtggaggaaattgagatttattgaggttatgtagtttgtttaaggttaagtttgggtgtttgtaatttttgttttgtgttaggttgttttttaggtgttaggtgagctttgagtatttgttgtgtggtagttttttatttttttatgtatattttttttttttttttttaggttggggtttatagatagttttttggttggtctatttttagtgattgtgtgttgattaggtgtttagttatgtggtctgtttttttttatttaattttagggttttatgggaaggattagtaggaggtagttttggtggatatggtgaatgatggtgtggaggatttttgttgtaaatatattttttttatttatattaattatgtgagtatttgtattagggttgggtattgggggttgaataaagaaaggggttttttgtgtttttattttttttattttttaggtggtttgggttgatttttttttgggttagggtgtaggggttgggttagctttgggtcaggggtctaggggtctgggataagatataatttgtatttttattgtttgggatattaattagttaagtaatgggttatgggggtgagtgtaaggatagagatttttagtaattggtggtttttgattttttggggtggtgagggttttttggagtagttagaggtggaggaggatttgttgttagtttttggatggaggtgttggtatttttagctgaggaaaatatgtagatatagagtatatttggggatttgggattagtttagtagaggtagtgtgtgtgtgtgtgtgtgtgtgtgtgtgtgtgtgtgtgtgtgtatgtttgtatttgtgttgggtgggtaaggagatagagatgggtgggtagtaggtctaggttttgaaggtcttgaatttattggtttggagttttttaagggtaatgggggtcattgagaagtttgaatagggttgtgtttgaatgtgaggtttagaaggattttttagagaagttagctttaaagcttttgtaattatttggtgagagaatttagtaaggatggataggtagaatggaatagagatgagttggtagctgaagtggataggatttggtattagtttggttgtggggagtaagtagaggagaatttgggattttggtgtttggtctggggtagatgggggtgttttaggggttgggagggatgagagtaggatgatatatggtggtgtttggtaggaggtgggtaaggatgattatgtgaaggtattgtctgggtaattgaagttttttgagattttgttgttttagaattagggaggtaagatttttattgtgggagattaggtgagtatttggtcttatgttgttttttttttgttattttttgtttttagatggatataggtgtgagttatttgtttagtaaagtagagtagatttaggggatgggtttaggtcttttgtttttaatttttttagtttgtttttgttggttgagtttttagtttttttgttttgtagattttttttgttgattataatttgttggatttgttgttgatttatgaggttttagtttttggttgtttggatgtgttttttttgtttttagtatatgtggggtgttttagtgtctggtctaagcttaaggtctttttggtcttttttgagtatgtgaatttttttattaatggtaatgggaaatagtgagggttggggggattttgagtgggaggtagagtttgtttttttttttttaggattaataaaatttttaagagagctattatgagtattgtgttttttgggatggggtttaggggtttttagttttgaggttggtgggagggtagagtagaggattagaaaatagcttttttagtatagttagtggttttttggagtttttagtttggttgtgtttattgaattttataaattagaagaggaagaaaaaaaaagagagagagaaataaagagaaata

SEQ ID NO: 46 - DNA, 6343 bp, Artificial Sequence
  Bisulfite treated PITX2 A after artificially treated at ggcC, agCt, Ccgg
gattgtttatttttgttattagctgaaggtaaggtcgttttgttatgagtgttttttaatttttataaaatgaaaagaaaaaaagggaggattattagtttattatttagaggaatggggaggttgtaaaaattgttgatgggtagaggtgaagatgttttttttggattgtattttctggtgttttgtaattagagtttagttgtgggatttgttgaagaaatttgatttttttgttttggtgagattttaaaaattagaaatagaaatttttagagttagagaggaaatataattaaatagtatgtgggtatttttttttttatttttttttttttaaataatattgttttgagtttttattgggtaaagagagaaagtttgagtttttatggatgttatgtggaggttagaaatggtttaaaatgtagatttttaattagttttttttgtggttgaagaggttaattttttttataaaatgagtttatttgttgattgttagctattttaaagtgaagggatttagtatttaaaataaattgagtaagtttgtttgtttgtttttattgttaatttaaatgaatttaaaatatggagtaatttaagaaaatatataatatgttttagatagtttttaaaagtagggaaagtttagtatttatatagtgattagggttagttttaagtgttaagcttttttaaatgtatttattttatgtatatttttttgagttattatatatttttaaaattgtgagtattggtatattgatttaggaagagtaatataatttttagagggaattttatttttaattagggattaaagagatgtttttttaatagtgggtctgagttttgtttttaagtaggaattaatattggtgggaaaatttgaatttaggagtaatggttgtgttctggtattttttaaaaatatatattaataggatgtttttgagattgaaaaaatattgttttatatgtttggtagaagtttttatatttggttttttaggtgaattatatttatagtttttttatttagaggtaggatagagttaaaatattttgtttattattaaaatatatatttttgtttaagttaagaaattagaaaattagggtttagaagtaaggtatattttttgagtgagaatatgttttgtaattttatatattttttgttttgtaggagtaaatgtggatttgagggaaatttttttttttatttttatttttattttgtgtaatttaatattatttttgttaggaattttaattttgttattttaaaaaatgagatatttgtgatttagggtgaatttgttgaatgtaggtatagtagaggaaattttagattttatgagtgtttgagttttgtttagtgtaaattttttgtgaatattgggttagtgtgtggtcgtgtttatttgtgtgttgatatttttagtatgtttggtttatttgttttgattttgggtgtggtgttttagctaagctgggtctagtgttctggtcttttttagctgataagtttagcttgtttgtttctggttgtggtctttttatttttttttattagcttattttatttttttagatttttttttatttatttttttttatttttattgtgtttatttttatttttgttttttactggttttttatttttttttttttgtagtttttttttgttgtgatttttttttttaattttgtaggtctgaaagaaggttatatatgtatgtttatatttatattttatatgttttgttttaaataattttatgaatattgttttttgttttgttttttgggtcattttttttgttgtttttttttagtttgttttgatttgttttttaaaagtatgtttttgtttttttgttgttttggtgttttttttttgatttattagggttgctgggttggtgtagattgttttttttttttttttattttatttttttttttggtttttttttttatagtgggagtttgtgtttttgttttttggttggtttttaagtgttttgttaggttttttttttttttgtttttctggttctggtttttgattttttggtctgttggtatttgttttttttttttgttttgttttttgttgtttttgtttgttttttctggtgtttgtctgggtgttgtgtttgtttttggattgttagttgtgtagtgggtttgctggtgtttgtgtgttattgtgtagtggagtttggtggaatttttgttgatgttatgttattttttatatggagtaggagtagagggaagagagagggatgagagggagggagaggagagagagtgtgagattgagtgagaaagctggagaggagtagaaagaaattgttagtggtggttagattttggaggtcttagtgtatttgtggatttttttggaatttggtatttttaggagttttgtagtttttttaggtctggtttttgggtgtttgttgtgtagctggaggtttggtttgttggaaattgttctgggaagtagtgggatgtggagatagtagcttttttctggtagctggtaagtggaggtcatttattttgtagggatgtgagataatgtgagtttggaaatttgttttattttggagaatttttattgtaggtgatttgtggtttttggggttaagttttgtttaaggtaatgtagttggtaaatagattttgtaaagttttgttttttttgttttttgttatagatattaataatttatagggtgttgaagttgagagggaagttagattgtggttggtatttaaaatgaggtatttttttttaaattttggtgttaatattgtaggaataaatttttgggtcaaggattagtatttttaagataaagggttgggtataaagttttagctattggaagattagttttttttttattgttatttattgggaaaaaaaagaaaagaaaaagattttattttaattggtagttagtgattttttaggtctaagtgaattatttgggagttaggtctggatgttaagcttttattatttttttggattgtaatttttttaaattgattattagttaattttaatttggtattttaggagatatattttaaatggatgtagagaattattttttagctggagattaagaaaaaaatttttgattttaaatttttgaaatatgttttttttttttagtttaattattttatttttttaagtaatttagaaattaaattattataaggtggtgtgatttttttttatttttttgtgtgagtattgttttattaaattaaatggaaaaaatttttattattataaatgtaaatattagaatttatatattttaaaatatttttatgaaaaattaatttgatttaaagaaatttttttgtatttgttttagtttattaattaaaattaaagatgtttttattatataaaatattattttggtagaaatttatttaaaatttaaatattaataatattaagaaaataaagtatataagtaaaataaattgaagatttttgttgatgtaatatgagtatataatattttaataattaaattttttttaaaaaattaaatagttattttatttgtggaatgttttattttaatttagtaaaattatatttaaattatttaggtgttttgttttttaagttaagtgtgtttgtttttaaatgtttttaaagtatttatattaattggttgtaaagaatgtatatatatggtaaaatatagaattgaattgagtagtattttaatttttttaaataattatttattataaattaatttattggttaattttataatttagtttatttaaaatatatgtttttgtgttgtttatttttaaattttttattaaagattttgttatggggtaataaagtgtatgaaaaggggggaaatgtgaaaggatttgggattatttgaattgtattttttttgtatttttagttttgtggtagttattagaaattattttttagtaaattgttttattttttagggtttgtttgtttgttttgttatggttttttgttttttgttagttgtgtagtgttttttgtgtgtttataatataaaatttaagttggtcaaaataagagtttttggtatatatattttaattagaatatgaattttgggggtgagaattattttttattaggaaaagttttttattttaatttgtgagattagttattgaagttagttttgaagtttggtagttaaattttttatagaagatttgttttgatagggtaagtttaaggattagtaggtgggaattggaggtttttttttaaaaaattattttttttagttatttagatttagtttttttagtaggtctggttattaaatgaagtataaaaatgtaagttttaaggtttattttgattgtaaaataaatttttaagttataaggatatgtaggagtgagctaaggaatatgttttgattttttttttagtttttagagtggagctttatgagtttttgaagatttgttttgtattgttttgtttggtttttagtattgaagtatggggaagtggggggaagaatgtgtaataattgattgattttatattaagtaatgtaattttttttttttgtatattttattttttaaaaaaaataaataaataaaaattatttgtagttattatttgtagtgttctggttattagctaataatgtagttagtttagatatataaaaaaaaaagattattgaaatgatgatgatatgtaaattttttttgaaattattataagtaaatatttgaagtttggattaataaaattttatttgtgttattttatattgagttagtagaaagctgtgataatgaattttgtaatattttatgaatagatattttaattagggattaattttgtgattttattgtagaattattaaatttggagttgttaaattgttatttttgggtctatgggtctataaggattgaattggtagagtttttgtttgtgtttttgttagtgggtgggggaattgtttggtcgtttttattttggatttttatgttatagtgctgggtagttttttttgtaggtagtgattttggtcagaggttttttagggtctagctttttttaggagaggtcgagatgtagggaaatggtatttaggtcagaggtaggtctgtagctttttgttttgtttttgtgtttttgttaatttgataatgtttgtttttattttgatttttgtatttgtgtgaagtgggtcttctggttgttggtgtattttggttagtgtggagagaggtaggtgttgagattgaaggggtctagggagttttggattttttttttttgtttttaaagtaattgtggtttttttatttatctggtggagttttttgagatttattttttctggtttgtttgtggtagagaagggggagtgtgttaaatgtttggtttgttgtgttgtggttgaaaatgtgaaaaagatttggtttgtctgggagagaaagggggagaattgggtagtagttatattagagctatttttttgtttttggtgggtagtaaattttttaagaatgtttgttttgttttttttagttttgtttagtttatttagtgttttttttttgtgattttaaattatattttagggtaattatttgtagtaagtaaataaatggccgggttagtatttttaggagaaagtgtggttaaatatggaaaagtggtttttgatggatgagaggtctgaatttagcttgtttttgaaatattttaggtcaagagtttgtttgttttagaattatagaaaattgagggaaattgttgtttaggataggggtatgttggtgttgatgttttataaatgtttattgagctttaattaatggataagtattgaagggtggtttttgtatatagctttttaaagagaaaagttttttttatttatttatttttgttgttattgtgtttagatgagtttttaattctggtattgagatttttgaaagtaggtttatagtttttttagtatattgtggttttatagttttttaatttttgggtatttttgtggtaattttggagggagatttttttttgataaataaatgttttgggtctgaggttaggttggagatgttgttgtatatgttagaggttgttaggttggaaaaatatgtttgaagtttagtatatagtaggtgtttaatagctagtgtaatgtagttttatttgagttttgtttatttgatggtcgttgttttttatagtttttttttttttttgttttgtaga

SEQ ID NO: 47 - DNA, 9001 bp, Artificial Sequence
  Bisulfite treated PITX2 B after artificially treated at ggcC, agCt, Ccgg
agctgatggatttgttaaattttttttttttttttttttttttatattatttgttagttataatggaattttttaggtttaagttaaagaaaaattggagagataaaattagattttgtagttttttttttttctgggaatgtttttttttttttttttagtttttgatgaatggttattatttatttttattaaatttaaataaggattgttgttttgtatgtttaattaggtaggtagagggaattggtttgtttaggaagtagtgattgagatgttttggtcaagttagtgatagaggaggggagaaagaatttagattaatttgtatgtagtatattttatttttatgaaataaaatatatttgttttatatttgttgaaaagtaaaataataatattgtatgaaatgttatatatagggtaggttgtatatagtagttttagaaatattattgtatttattagagaaattattttaaaattgatatttatatattttttataataataataatatgttagaaatatatagtgtggtatttagtatatatatttttttgtttgtaagtgaaaaattttaattgtttttgtataatatgttttattttaaagtttaatttttaaaaatattgttgtgatattattaataattgtttttataaaattaatttgatattttgatatatatatatttttttagttatttaaatgttaataatgttaaatttaaaaaataataagcttatagtaatgttaaaatgttatatttagttaaatatttgtttgtgtatgtgtttttgtaattgttagaaatatttgtagtgaaagatgttagatattgaggatatttttttgaaattaaaggagctttttttttgatttagtggtttttttttttttatatagcttttttttttttttttttttttagtgtttatgattttttagtataatttttagttttttaagggtggagttgttttatctggtaaggttttaggattctggtgttgtgggtgtggtttatatgggccggtttattgtatattggtaagtatttaggttggaggccgggttttgtatgttggtgtagttgaagctggagtgttgttttgtttttagttttaggttggtcaggtttgagttatatgtgtttttataaatatatggaggagttggtggtgtgtaaggataggtaggtgttggtattgtggaatttagtgatgggttatttaggttgtttaagttatttaggttgttgagattggagtctgggatgtttgttattgttgagggtattatgttggatgatatgtttatggatgagatagagttgggtggggaaaatatgttttgtgatgatagggggttgatgtttatagagttgaagaaggggaagcttttggtggatagggaggtggatgtaaggtctttggtggtctagttgttgtaggaatagtttgggtatatgttgttgtagggttgtatgagtttattgaattgtggtctgaagttatttttgtatagcttggtctgttggttgtgttttttttttttttatttggtctgatgatttttgaattaaatttgggggtggttggggtaagggagtaaatagatgttatagtgtagattattaaaatttttattggaggtcaatttttgtttttttttgatatatatgttagtgtatttatatattttggtcttgttttattgtattgttttgtatattaagatattagggtcagcttttagttattggtctgggtttttattaagtgtaggagatttggtttgttttggtctgtgagctgggatttggagctatgttataaattttagttgaatgtatggagatttgtggatggtttgattatttagttaggtgtttttttaggtttaaaaatatttaatgtaaaataaatgtggggtagtaggtttttttaattttttctggggtattttgtaaatttgtttttattttaaagttatagatttatggatgaggagaaggggttggaagggtattagaggattgtttttttttttatgtaattttttttttttttttttgatttttattgttgttttttattttttggtatgtgtttttttaatagggattaggtcgttaatatttttttttgtttagtaaaataattaaataaagagtaaaagattatttttttgttagcttgttaattttaggagcttggtatattaaattctgggaatctggaaagggtagttttggagattttttttttttttgttttgttttttttttattttaagtttattataggtctgtttgtgtgttaggtctagctgggttgtttggttttgtaggtggtcatttaggccggccggtttttatttgtgtctggtggtctagttgtaattttgattttaatttatattgggtctttttgttgttttagatggtggtttttgtgtattggagagaggtctggtctgagatatttgagctgatattagtgatgttttatattatatatttttgctgggtctagttgtgtaatttgttttttttttttttttttttatttttgattttttttttatttttttttttttttgtatttgattgttataaaaagtatgttttatttttatttggtttgataagtagttgttttggaaggagaggtagctgtaaggagagtttagtgttgtggttataaagtattagggtggagctgtggaatagtgggtggggtgggagggtgtttttgaaggattttagaaaatttatagattttgtttttaattatttgttatttttattttaggtcatttaaattttgtttaggtgagaagagtatgtgagaggtctgtttttttgatgtgtaagagagctaatgaaagattgattttgtttaaaattatgttgtttaggatttagctttggttttggatagttaaattaaaattatttttaatttttttctggtcttttatttattagtatagttttatgttttgtataaatgttatttagagagtgtttttattttttttgatttgggagagtattttggtttttattttttttattgttgtttttttttttttgtttgttttgttttaactgggggttttattttttttatttagagtatttaattttttttttttaatagtaaagtttttggatgttgtttgatttgtttgattttgttttttgtttttagaattttaataaatttggaattttttattgattagtataaattaggatgttgttattgggttatttatttgagcttatttttgttaatttataaagtatagatttgttataaagttaaggtaagttttttttataaaattatgattataatttagaagagggggtgtgagttttaatttttagagtttaatttttgagagaagataaataaattaagtagaaaagttttttttttttttttttttttttttttaagaggattagtagttgtgtattaaaattttgtttctggagattataaaattaggaaatagggtgtgtgggagagatttgaatggtcgaaataattgtaaagaaggtgtaagaagtgtgagtttaggagggaaaaagctgggtcagggccgggataaaggttttttagggagggtcaatttttttgtgtttttggtgggttttttttgttaaaggtttataggttggagtttgtttgtggtttttggtctggtagggattttattagctttgttttggtaattgtaagttaggaatataatgttttgtgtaggggattgtttatgtagtttagcttgtgagattgtgggatggtggggtagtgagctggtgttgttttgggagtttgagttagggtggtagttttgttggtcttggagagggaattgtaattttgtaattaggtcgttgtgaggtcttttgtttttgtaaagctgtgttttactggtgtttttttaggtggtgttgttttttatatttttttttggtttatttggtctgtatttttataatattttttttttattttttttagattttgtgttggtttttatctggatttgggtttttgtaaggttggtttatatagtgatttttttgtgtgtggatatgtctgggtagtggtttttttggaaagtggtctttagcttttggagctgttggttggtaaagtgagtttgttgttgtttttgttgtttttttttagatgggtttttggtgtttatgtttttattttttttttgttggtttttatttttttttgaaaatgaaatatatatatttttttgttagtatgtttatttgtaatgtggatgttaattggactggtggtagaagttgtggaagagctgggttgtttggtgctggaggagggtgtgtgtggtggttctgggtcgtgaggagtgttgtgtttgtggggtgtgtaggtgtaagtgtgggtgtttgtgttttattttttttttttttttagtgttgtatgttttatttatatgtttattttattgtagtggtatatttatttttatagtttgtgtttttaagtatatttatatatttttgtgtagatatattaaattttttgggatgtgtatatgtgtgtggtttatagattttttttttttttgtagaaagcttagatttttatgtggtttgggaaggttaggaaaagatgtggggatttggttgggtattgaagtttgctggtctttttttaaaaaaaaaaaaaaaatgtttttttgtgaagggtatttttgagtggttttaggtaattttttaatgagtggagctttttgggagctgaaagttgagaggaaaatagggatagaggttggtggtctttgaaggtttttgaattaagatgttgggatttttgtgatttaggaaatagaagggaggtcagggtatgaatagagagggtggtagaattgtttgtgtttttagtgttttaggagctgggccggttgagggagaattaaagggatgtggggtagttaaaattctggtttctggaagttttgtggggagttaggtgaatgattatttttattatgtttttttctggaggggttgatttttttggggtgagagggagtgggtggtgtagagtagctgagtgggaatgtttgtagggtggtgtggtgttttatttgtggtctctgggttggaggtgttggagatggtgtgtatttttagtttgtgtttggaggagtttagtgactggggttgactgggagttagaattgaagttatggttaatggttggggatggtgataggaagatgaggagatggtcgatagcttggtttttgttgtttggtgttttaagtgaagtgggtcttttatgtagtttatggatgagggagtgtgatgttttattagtttttggttattgttttgttgagtttttgtagttgttgttgtttgttctgggttgtgttttaggtgtggagtttttttgttgtggggagagttaggggatgtaatttttgttgagtttttaagttaagctgtttttgttttttctggaaggtttaagtgaaaaagtctggagatggaaagttagtgggtaaatgaagatatgggatgtgggtagaagggtattatttagagtgtttttagggagtaggtttttaagctttaaagtgaaataagagtgggtaaagatttttttttttttttttttttttttttaagaatttttttaataaggaaagctaatgttgattgtgttttgtttgttttttttttatgtggtagttttgatagagaagtgttaagagtgatagggataggtaggtgatattagattttttgtggtggtagtagttgttgtagttatgatgtggtcttttgagtgtattttttgtaatgtgtatatgtatattttttgggtggttgaataggagctgggtcttgttgtagcttagctttaggtatttaggtgagtgatggattagatttgtggttttgtgtttttttgttggtctaatattttaaaattagaggtgggttttttggtgttgagatgttattttgttgtggtcttttttagttttttttgtttttgtttttttttagatttttttctgggtgtgattgatgtggttttgtattaattaggatgttttgagttgtggtggagggattgttttgtttgtatttattagtagtgtggggccgggttattgttttgttgtgtgtattgggtttatataggtaagcttctgggaatttagcttttgtttagtttaaggtgatctggtttttagtatgaatttaaaggtgaagagatgaggttaggagttgaaggtttgggagaagagagtggaatggttaagaagagaaaggtataaggattaataagatatttattttttgtgttttattatatttatttttaattttttattttatataaaaaggagatatgttatttaaaattagaaaatttgaaaaatagtaataaattatttttttgattttaaattttttaaatagtttgttaagtgaatgttgtgttaatttgaagaagctttaattgtaaagaagatagagttttgaaaaggtaggttaataaattagaaattgagaagtaaatggatttgttaaaagaaaattattttgattttaaatgaataattgtttggtggtttattttggatttatataagaataaaaagttgttttagattatgttttttgtgatgtttattagtttttagatagaaaatatataatagaagagaaattttaatttagtgtttttaaaatgttgaaagcttatttattttatttaatgttgattaagatatatattttagattttttaaattttttgtatattgtattaagcttgttttaatttgagagagttatgttttaaatttgatttttttgtttattttattattaattagatttaaatttataaagtttgtagaattaataattttgagctaattatatatgaaatatgttttaatgaatttttatataattaagaatgttgttaaataattaattttaaggataatttttaatagttattttttttttttagtgagcttaaggttgttttgagttattaaagtttaagtaggtagaaggggtgtgtgtgagctaagggtgaaaagtttagaattgtgtttaattagtaaaagtaaaattttatttatataaaataaaaaaaattatttttggagatattaattttttatagtattgtttttaagtaaatttaatttttaaagaaattaaagaaagaaatttaaatatatttaaaataatttttgaaagtttttttgttttttagtataggttagctggagaggataaattaattttttttgggtttttgtatgggtgattgttttattatggagttagtgttattatttttgaatgtgtatttgtttgatattatagttaatgatttgtaatgttagtatgaagtatttttaaaatattttttttttgtttttgtttataagattgggaaatttatttgatgtggaataaagtggatgaagtagattataaatatatttgtaatttatgtgttttttttttgttttgattatttttaaattttatttgtaatttttttttattttaaatttgtagtttaaagatgtatatgagaattgttttttagtttttttttattagtattattttattttaagaataatttagctgtaagggaggaatttttttatagtaagctttaaattagtatttttgtttttaattttttattttattttattttattttatatatatagatatttgtttagagtaaaatatatttttatgtgataggtttgtattagctgaggtttatatatttagctatattaggttttgtaattttattattaaattatatatattatattagtagtttgttggtaaagaaggttaaattaatttatattttgtttattatttggtgtttaaatgatgtattttattctggagatttggtggagaattttttttttagattttatagtgttttattgaagataatgtttttatatttgtagtggtttttaatttgataagattttaatttgtttaagttttttaaataagggttttaaatgtttttagttgtttttttattgaattttttttaatttttttaagattataaagtatatgtgtaaagtaaatatttttttttattgtattgttagttgatgatttataattaagttaataagaatttagcttttttttgttgaatgtgtttattaattatattttagtttttttttttaaattttagaatagctgtggtttttataatattatgttttttaaagctttattttatgaagggattttattatattaaagaatgaaaaaaatttttattgtagttagtatatatagttttttattttttgttttttaagatttaaattttagagctgtaaatatttttggaagcttgggtgttaatgttttattttagaaagttgagaagttttatagagttatatagatttttaaatttattttttataaatttatagaattttgataaaagctttggtggttttattttattgatggaatttttattatgataaatatatatgtatgaaggattttaattagtttttaaagtggttgaaaaatttaagggtatgtgattgttttttatagtgttaatgtgtgtgagatgttggaagtattggggattagtagtagtttagatgtttaaaaagataaggtgttttaatttgtgtggatttattgaagttaagtggtgaataaagataattatttagataatttagattaaagtaaaagtaaaattatatttatttgtatatatatatttatatttattttatattatagatatatatatgtatatatatattggttttgtaaataattgatttaaagtgaggattttttttgtatttttttagtaggagttttaatatttttttaattttttaattattttata

SEQ ID NO: 48 - DNA, 1920 bp, Artificial Sequence
  Bisulfite treated RASSF2A after artificially treated at ggcC, agCt, Ccgg
ttaggttgttgtagatatagtttttgtttttttgaaaaatatgttttaggtgctgggattttagatatttgggaaatagagtgtatgtagctgttgagaggtcttgtgtttggttttttttattattgaggtgtagaggtgttgtggatagtttagatttatatggtgtttgaggtgaaatagaatttttagtttttttatgaggtcattggtatttttggttgtttttagagctttttgatttagagctgaatgtaaagtaagtgtttgaaatgtagaagtagctggggtcgtttatggtatttgttttgtttggggtgagagaagatgttaggttgaggttttagtgattttaggtattagctttgaaggagggtggggagattgtaaaggggaagtgtctggagggtcaatggtctttgtgtattttgtgtttttttgaagtgtgttgtttttttgtgctggggattgggatttgtttttggggaatttgtttagaagatggtggtggattggggttgggtattttttagggttgttaggtcttttttagttttgtatttgttgtgttgttttattttgttaggaagttttagagattctggggatggggtgggagtgtttttttattgtgggtttaaaaagaaggaaggatgtttttaggggttgtagaaggaggattagctttaagttataattttttttggatttaaggtaggccggttggggttttgtgtttatatggtctttggtgggggtttgtgtgttctgggagttttgtggtttggggaggaaagaggagataagagataggtgaggattatggggttgatttagctggggtagggattattgtggaaaaattttggtgaggtggggggatgtggaaagagagtggtctgtgttttgtattttgtgctgggtattttgtgttagtgttttgtttttagtgttttgtgttttgtgttttgtgttttgtttttattctgggtcagctgtattgtgtttgtgttgtaggaattgtggagttggaaagtgggggtgttgtggttggggggttgttttagctgtgttttggtcagtgattggtgggccgggtttaaatttagttaggttgggtaggtggtggtcgtgtgattggggactgggtgttttgttttttttgtttttttttttttttttttttttttttttagttttttggtcttttttagtttttactggatttgtttgtttgttgttttttttttttttttgttttttatattattttttatttttttgttttgtttttgtttttttttttttttttgttttttgttttttttttttttttttttttttttaggggtggagcttttttttttttttttagataatgttgtggttgtgtttttttttttgttagcttgtttaggtttttgttgttagtgatttttctgggttgggggtggggaggtggggggggagtgtagggttggggaggatgagctggttttttttatttttttgttgttgttttttttaagagggatggagatttggtctaagctttttggtttatctggagctgtgatagttatttttagggaatagttatgttgttttattaagtttatttttagtggtctggattttttaggtagaggttgtgggattttgttttttttaatattttagcttatttttaaaagggtttgagctggataggggttaaataggtctttttgatttggtgggccggtcagatgtgatagtaatgttaaggaggtcaagtttttttgtttattttttattttttttttttttatttttggattttttggtgtttttagtatatagaggtctttgagtagtctggttgtaggttttttatttatttagagtttttttttttatgtgtttatttttaattttgta

SEQ ID NO: 49 - DNA, 5473 bp, Artificial Sequence
  Bisulfite treated SHOX2 after artificially treated at ggcC, agCt, Ccgg
gtaatgttaattagctttattttaaagaaaaattaaatattagagtaaataatgatttttttgtggagaaggagttgtaagggttggggagaggtaattagtgttataaaagttttattataaagaagtttagaatttttttgttttgttgtgtagtagagtgaaatatagtagtagaataattgtgtattattattatgataatttaatttgtttttttagaaaaagttattgtttgtagttaggatagtaggaaaatatttagaaaataattaaaatgtaaataaaagtatgaaataataataaagtttattttttaagagaaaaaaagaagagtatttagtgaaaggagaatgaagtatatataaagtaagtaatttttaggtattttgtttttttggatgttatttgtttaaatttgataatttttataggtagtatgatagattttttaaaatttaaataaagcttgtttttgtattttatttttaataataaagtatattgattgatttataaattaaagtttttaaaattttattaaagtaaaaatattgttttagagcttttattggtatgtttttgaaagtaagtgttatagttaatgtaaatttttaaaaatttttttgttatttagtataatagagggtggattttgtgttagggtggtattttttgtgtaatttatatggtctgaggttttttgttttttttttttttagaagagttggaattaagatattaataattataattgtaataattattattatgtttttaaggggttgttgagtttttggagattttagtgtatagagtgaagtaggagaggtttaaaaaggaaggttttgttgttgatgttgtgatgattaaggtagtttattattattttttttttttaatgtgattgttttgttttttttttttttgattttgttataagatgtggggaagttttttaagaattgtgtatagtttgttatagatggtggtttttgtgtttagagattgaaagagtatttgttatagtgatattttgtaatagctgtagatgtgtgggtctaaaattgttttatgtgtttaaattaataataattattattttattttattttattatttgagtggaaatataatttgaaatatttaaatttgttttttttaaagctagaaggatatgtgtatgtgaatgtatataatttgtttttttaaatgtttttaaagtttatttttgttattatatttgtttttataattaataaagaaaatttgttttagttttaattttattgggtatggtatgtgttggagggtaggttttggaaatataaatattaatatatgtggtttgttttaaaatttaatgtatttagggttagttttgttgttttggttaaatgaatgaataaagagtgattaaaatgtgtttatttttttgttattttatatatagtttgagattgattgttaatagtagattgtaaatttttgtatttaatagttattaattttttttatagtttgtatatttataaatttaattgggatatttgtttgataaatttagattttgtagagtagatttttaaggaaatttaattttagagaataaaatattttttggaatttttaaggtatttagagataaaatgttttttgtgggatttttttttaagttttataaaagtaggtctattaggattaaattatattaaagttagtgtgaggtaaggggggtgtggtttatagaaattttgggagaaagtttagtatagctttttttttttgggaatatatgttaggatggaaaaaaaaaaaaggaggggagtgttataggattaagatttattttggaaaataagatttttagtaaagatattttttttttttttattttatattagatattagaagtattattttttgagtgtgttttttaagtttttttttaattttaggttttttttgttttttgggtctttgattttttggtagctgggtatttgtatttgggtctttgataggtctagttgttggtttagttttttttgtatgaaggtgttgggatagtgggttttgttaaaaagtttttttagcttattgagttgttttagggtgaaattggtttgattttgtttttgtttgattttggtttggtctttgttttttattttttttgtattttttttgtgattttttagctctggggatattggagggggtattttagtggggtcatatgtgtatttatatgaatatatatatatatgtatatatatatggatgaaaatagtatagtaaattttgttattagatttgttgtaaaaaagaatagagaattttttttttttgtggaattttggtctggttttttaatttatctggaggaagaatattctggagaagtgtaaaggttaagtttgagtggtcgtttggggtaaggtgggtagttatttattattttttttataaatgtattttgatttattgttttattatttattttttagttactggtcttttttagtaaatattaaatggtttttatttatttttgtatttatttgttttgtagtatttatagaaattaaaggtgtagtgttaggtcttttatagagtaaagtttggatataagggtgtggtaaggtcatttattggtcttttatactggtcatttttagaaggttggtttgtttttaggtcagcttttattattgttggttttttgtttattgtaaatttgttggtttaatttaggaataattgggtcgaaaggtattagtgagagtaatagattctggtgttgtgttgtatagggagttgtatttgtagatgttttttgttgtttttgggtttgggtcaaattttgtataaggttttttggatagttaggtaatttttgttttgtttgtttgactggggttgtatgagtataggtgtttatgttatgttggttgtttaaagggtttgttgtttaagctgggtcagaaggtaggaggtggaaaattagtttctggtggtgggtgaaagtaattgttttttttgttttttttttgtttttttttgtggaaatgtagatttgattttaaatgtttaatttatagagattaataggtttaagtggaatatttgtgatttttggtttttattggttgtttaaagtttttttatgtaattagtagcttggatgtttaataaaatatgaatttttttgttttgggtttgtatatatttgttgttatttttttgttttttttttttttttaaaaataggagcttttttagtgtgagtatatatagttattatatatatatttttttggaatttttattttttgtgtttgaattagagattctgggttttaagaagttaaagctgagtttagatagttgaggttgtttgtagttttttttagtgtaggatttaggtcagtatgggtgttaaaaattatttctggaagagctggtttgtagagaaattaatatttgttttgagcttggaaattaataattttaggaattgtgtttgctgggggtttagatttgaattttgttgttaggtgtgttggtgaatttgtagtttgggtctgtagttgtggatttatggccgggaggttgtattgggtattttgatggtaattttattattttataaatttaggaagatttggtgttggtttggaggaagaagagttgttagattttggtcttgctgggtattttagctatggtgattttaaatattgttgtattttttagtttttagagttagttttgtggatatttgttttttttttaggaaggaatattatagtaaatattatgggtcaatttaatagtaaagtatttttattgatattgtattgaaatttaaatatgaaaatatattttttaaattttgttaatgaggtgggaaggttttgtttattatatgttatttatatagtggatgttatttaaagttttggggttttgaggagatgtttaaattttaagttgatttatagatttaataaaatttttatttttgtttttaaatttttaattattgatttaaataggaatagattgtgttataaataatttaattgtttgtttaaatatgtgattttatgtatgttatatatttttttaattggaaaaatatggtagtatattagttattgtaggtattaagtgttaaattaattttattgttgaatttttttgaattggtatagaatgttttgttattgagataaagatgttttttaatattgagctagtattaaaggatttttgttttaagagaattgagtattgggtgattgaaaatattaaaggaattgtgtaaatatagatttttattttttttgttgttttttttttttgtttttaatatattaagaaattgaaatgttttgtctgggagaagtagtgtagtttggattttagcttttgttggtttttttttattttgaaagagaatgggaagttttggtctttaagatttaaagatttaggggttttgtggagtttgaggggttttggtggtcttaaatatttaggtgactggagggttaagctttttatttttgtttttttttttttctggtaaattttgtgttagaggttagctttagttttgttgtttggtttagtatttttttttgtagtctggtcttgtgaatttttatgtttgtttgtgggtcatctgggttgtgggtctatttttttgttggtgaaaaatgtattttggtggaatgggaatatttgggaagggtgtgtataaattttatatgtttttttttatgttatttttataatatattaggattttatttatgattgagtatattactggatttttatttttttattattattttagctgataaagctggggtttagggtcttttttgtgttttttttttttttttgttgggtcttggagtttttttttgtttgagaggagtctggaaggtgggaaggggaattgttgctgggggttagttaggttgttattttttgttagttgtgggttgtctggttttttgttttttttggtggtgtttatgtttagcttctggatgggagagtgtttttttttagcttttttgtttgttttttttttttttatattttttttgttttttttgttgttgtttttgttttttttgttgttgtttttgctggtcgtctggattgctgggttgttgtggttgttgtggtctgttttggtgtagctggttggttttttggtcttgtgtagtggtctgttttttagtattttctggtatgtgattgtttttttttttttttttattttttggttaaaagatttggagatgaatgttgtaagtttttttattgttgttgtatgttagtctggtgtttaatttttgttagtagagttttgtttttttttttttttttttttttttattgttttagtttttttaataataatatattaatgggataggaggtgggg

SEQ ID NO: 50 - DNA, 1405 bp, Artificial Sequence
  Bisulfite treated of Septin9 A reverse complement after artificially methylated at Cp[AT]
gtgggtggtgttctgagtgcaaaatgtgaatttgagttgtcaagtttgggtgctgctggatggtttcatctggaggttgttttgtgtttcactaagtagaggagaaattgaagagaatttgaagaaaggatgctgtggtctggatcatcagttctagaggctgaattcaaggacatttcttcatctagttttgatttcattcattcacacagatgcacagggattcaaagcatttggttgatctggaaagtcagtgatttctgtgagggtgcaaggggtgaggaagagggagtgtttttcagggcagtttctttgacacttgagcaagggctggagacagtgcaggggatggttggctcaggttgaaagtggtttgacagtggttctgttctgggaggaacttgatctgcagtgtgtttgttgtggggacttgctcagctttgggggtgtcttgtcacttttggttgcaggcactcaggtgagcagtgctggttttgggacattgatttcttttcattttgggtgtgaagttcatctgagtaagacttcttcatggtgtctttgtggttgttgctttcaggaaagtgtggtggtgaggcagtggggtgtgtgctttcagggtgctaattctgggttggtagtaggaaggtgggaagagggggtggtttgttgtctggagtgcattgattgggttttgttttggttttgtttttgttttgtttctttttggagatgtgcatagaattttggttcagttggctgtggttttgtttctgatttgttttctttttgttttgtgaatgtgtgtgttgagtttcatttttgttcatttctgtgctgtgctgcatctggtggagtggggctggtgggtgttgggtctgggagggggtgtttttgtgtggcagtgcagatcagatcagatcaggtcaggttgggggtgggggttgtctgtgtggtttgttgtgtttgcagctctgcattttcagctttttgtgctggtgtcaatggctggttttgggagttgttgcacttttcagttttgagtttgggtggggtgggtttggtcaggtggaagtgggtggaggtgtgggtgctttgggtggttttgttgggtgaggtggtggtgttgggcattgtggtggtgttgggcacagttgggggttggagttggggtgttggcttagtgggttggggtagggtgggacaggacatctgttctgctacttttctggtaatcaaaagggcagagtgtgttgattgagttggagtcttagttttctcatctgtaaatgggtgtgttggacagatgatcatttgttctttctgtgctgggcattgtgtgcagcttggtgtattggtgcagtggggcagacacagggagttgttctttacaacttgggtaatg

SEQ ID NO: 51 - DNA, 2365 bp, Artificial Sequence
  Bisulfite treated of artificially treated Q9HC74 reverse at Cp[AT]
gcatgtgttcaaagatgttcagatgaggaggtgttgtgggggaggggggtgggaacagcaagttctttcagctctgcagattcagatcttttctttctctgggaagcagggatgcaaagggatagagtctgaaaaagggctttcatcactaagctgacaaagtaactatgatgttttcagctcacactctgcacagtgtcagtggtcactggatcacaattttcttttgtttctttgttgtttcacattcttctcaggttcagttctgaagaacagtcactggcactctgcttggtgttcagtcaaagttctggtttttcaggaggttttgtctttttcactcagatagggctgatttcaggtgggttgtgtgggcagctgggctcaggacattcagatgtcagttctggttctggtcatggagtggggaggatctcaggctggtcatctttcagcttggtctgacatctggacagtttgctcatttcaacacagtctttttttcttttggttcatcagagggctctgttcaagtcagtctaggagtctctttgaggggtgggggcttcaggttttggcagaggcaggtttgtttctcagaagttctgtttcagagtgctggagatcattgtgtgagctttttctttgtctgctgtatttacttttgtggatgcaggatgcagagtttcagcattggcagtcaagaggatgcaggaaagtgcatgcactcacaggctcagagatgtggatgtcagattcaggcttggacagagcagttttgcaagtttcaacacactttgtaaattttgaagacaggagagagtcaaaatactctttctgtttgcatgcaggtttcttctgtttttcatggtttgattctgggaggtggatgaggatattttcaggtctggatgggggtcatgggacatttcactctagattctgtcatgatctgggctgtgtttgtttggtgcttttggttcatgggctgcacaacttggtggttttgaaactggtgtgggggaggggagggctgttcatttgagcaggatgtggctgttcactcagttggaggtgaggaatgatctttctattttgttgttgggttcaagtggggtttgagagttgttggggagagtcaaagggaggggattgatggatttttcagagtgaaactgtgtgttctggagagttttgaggcagtcttgtgagttcttgaggaggttgctgttgcttggcaaacacaaacaacaataaaaggaaggaaattcaggtggcagtgtgcagaatgagcacagggttctgtgagggtgtgcagggtctatgtgggtgtttctaacagggtttttcatgtaggtggtgtgggcatggggttgggggtgtgtggtgctctcagtgggagggtgtctggattaggggttttgtcttttctcagtgcacttttgtcttttctcagtgcatttttgttttgtgtcaggttcatttgcagggttctcttcagcatgtttgtggttgcagcagtcagttcagcattcatctttgaagtttgaaatgatttcattcagctgtgtgttgattgtggggtttgacatgatggctggtgggcagtgggttgtgtggagggcagtggtgaggaagtgtttttggtggggtttgggttctgtgtgctggctggggtgttgtgtttgtgcttctgcagtgcagagctagttgttggaggagtttctaggttttctggctcagctgaatgaatgggggaggaaggtgggtgttggtttctttttgtgtgctgtgtttttgttttgtttttgtcttttgggtggatcaggtttttgcatttgcattggtctttctgtcttgcactggctgctttgtttgtctgtcaaggtcaggtctggggggctggggtttgagtggttgctgggggacagttctgggcacatgattggagtgtttttcttctttttgtctggtttgtgttcaggggatggtgagagatgtggtctcagtttctttttttgggtgttttgctgtggtcagatgtgggtggatgtggaggttgggtcatggtgaggagggtgggtgttcagaggggaagagatttcttttcttttttgggtgcagggttcttctgcaggaggctgtatttgggcagtcaaacaaagttctctgtcattgttgttgtgtgctctgtgtctgcaagggttaaatggcagtgcatgtggctggcaggcaggattttggtctgtgggctcaagagttgaggggtgcagggtgaacatgtgagtttcatggcatcagtgagaggtcatcaactttcattcattgagggcatttctgcagctaacattttcatcatgatcat

SEQ ID NO: 52 - DNA, 4261 bp, Artificial Sequence
  Bisulfite treated of GSTPi reverse complement after artificially methylated at Cp[AT]
tatttctctttgtttctctctctctttttttttctttctcttctagtttgtgaggttcagtaaacacagtcaggctgagggcttcaggaagtcactgactgtgctggaggagctgttttctagttctctgctctgttctttcattgatcttgaggctgagaatttctaagttttgtttcaggaaacacagtgctcatagtagctctcttagaaattttattggttctggagaaaggaaggcaaactctgtcttttgctcagagttttttcaattctcactgttttttgttgtcattgatggggaggttcatgtactcaggggaggtcaggaaggtcttgagcttgggttgggcactgaggtgtttcacatatgctgagagcagggggaatgcattcaggcagtcaggggctaggatctcatggatcagcagcaagttcagcaggttgtagtcagtgaaggagatctgcagggcaggggggctagggactcagtcagtgggagcaggctggaggaattgggggcagagggtctaagttcattttctaggtctgctctgctttgctaaacaaatggctcacatctgtgttcatctggaagcagagggtggtgaggaaggaacagcatggggtcagatgctcatctggtctttcacaatgaaggtcttgtctttctggttctgggacagcagggtctcaaaaggcttcagttgtttgggcagtgtcttcacatagtcattcttgtttgtcttctgtcagacatcatcatgtatcattctactctcatttctttcagtttctgagacatttttgtctgtttcaggtcagacatcagagtttcagattcttctctgcttgcttttcacaatcaggctagtatcaaattctgttcacttcagctgtcaactcatctctatttcattctgtctgttcattcttgctgggttctctcatcagatgattgcaaaagctttagagctggcttctctggaggattcttctagatctcacattcagacacagttctgttcagacttctcaatggttttcattgttcttaggagacttcaaatcagtgggttcaaggtctttgggatctgggtctactgtttgttcatctctatcttcttattcatttgacacaaatgcaagtgtacacacacacatgcacacacatgcacatgcatgtgcacacatgctgtctctgctgaactggtttcaggttttcaaatgtgctctgtgtctgcatatttttctcagctaaaagtgtcagcatcttcattcagaaactggtgacaaattcttcttcatctctggctacttcaggaagttcttgtcatttcaggagatcagaaatcatcagttgctggaggtctctgttcttgcacttgttttcatgatttgttacttggctggttgatgtttcaggcaataagggtgcaggttgtgtcttgtttcaggtttctgggtttctggttcagagctgattcagtttctgcattctgattcaagaaggggtcagttcaagtcatctgaggggtaaggggggtgagggcacaagaagtttctttctttgttcagttttcagtgttcaattctggtgcagatgctcacatagttggtgtagatgagggagatgtatttgcagtggaggttcttcatgttgtcattcatcatgttcatcagggctgtcttctgctggttcttttcatagagttctggggttgggtggaggggagcaggttgtgtgactgggtgtctgatcaacacacagtcactggggatgggtcaatcagggggctgtctgtgagtttcagtctgggaggaggggaagaggatgtgtgtggaaggatgagagactgtcacacagcaggtgctcagagctcatctgacatctgggaggcagtctggcacagggcaaggattgcaggcattcaggcttgatcttgggcaaactatgtaatctcagtgggtctcagttttcttcacttcagagggctgtggggcagctgatttaaacaaaagggctttgggggcagaggcttgttcatgtctgttctggacttggaggttcaagactcatcaagggtgtggttcaggtgatgcaggatggtattggactggtacagggtgaggtctttgttctggaacttggggagctgtttgtatagctgttgggggaggcatggctcagggaggggcactgagcttgggtgttttttgattctagtcacagttttctaaggttcagcattttcttttcttgtttgggcatggtcacttatgcaggaggctttgagtgagttcttctgtcatgtcttcatggtcatcatcttcttctttcagctctggttctgatctgtcagcagcatgtgcagggttgtgcagtggtctgtggggagggagaagtatgagatgtggggattgggttgactttgtcttgcagcaatttggggaggggtcaggagtgcagggagggaacaggtaaacaggtttctttgaagatttcacacaacactggggtggggagcaggcatggtgggagaggtggggaacaggaaggaggtttggggtaaaagtcacatgatggagggataagggggtttggatctctttgggtgggtgaggggctgtgggctgcagtttcagtttctgtctttcttttctgtcagacacatgcttctatcttgaactgggaaatagatcatggtgtagggtggcactgcagtgaacaaagaaaagtttgctggagtttgggggaggatgtcaaggtgtggtgagtgcagtctgttttttctttttgtttttggggtttcatttctttttgaggtgctttgggttttctgaaagttgctaatggcactggggatgttctgggttttctaggtttttgttttgggtcttgaggtgggtgaggagttctgttgggagtttgggtctgatgctgtgggttggtttcatgctgggagctctgagtttcatttttggggagtgggttgtgtgtactcactggtggtgaagactgtggtggtgaaacttcagtgaaggtcttgtggtctttgagtcttataagggtggttttgttttgctttgtttcagtgctgagtcatggtgttggttgctcttctggagggttttgtggacttttgttggtttcagttttggtggttgctgcattttgggtgttggttgcagaggggtgttctggagtttttggagttgttgtgcagctggttggggaagtctttttctctttttcaggttttcagtggggtctagggagtaaacagacagcaggaagaggattgcagtgaagtgtgtgcagtgaactggtgtgttgggacattgtggggggaaattttctaagattgctgtgattttggagcttgcacatttgcttcacagggcaggggagaggggtggaggttgcttagaggaaaggaaattgctttattttattttattttattttattttattttattttattattttattttattttattttattttattttattttgtgttattttattttattttatgatgtagtctcatgctgtggttcaggctggagtgcagtggtgtgatcttggtggctcactgcaatctttgtctcttgggttcaagcaattctgcttcagtcttttgagtaggtggaattataggtgtgtgtcacatctggctgatttttgtatttttagtagagatggggtttcatcatgttggttgggctggtcttgaacttctgatcttaggtgatctgcatgtcttggcttttcaaagtgctgggattacaggtgtgagtcatcatgtctggttgttcaacttttatttgaagttctggggtacatgtgcaggatgtgcaggtttgttacataggtgtgtgtgtcatgatggtttgctgtacagatcatttcatcattcaggtattaagttcagtatttcttagctattctttctggtactctttcttttcagcattttgctcaacaggcatcagtgtgtgttgattgttgtcatgtgatcatgtgttctcattgttcagctttcacttataagtgagatcatgtggtcttgctggttttctgtttctgtgtgagtttgctgaggctaatggctttcagcttcattcatgtttctgcaaaggacatgatcatgtttcttttagtggctgtgtcttaggctattttctttggctttgctgtctactttctgttgatttgcagatcttcatttattctagatattgatctcttgtt

SEQ ID NO: 53 - DNA, 6343 bp, Artificial Sequence
  Bisulfite treated of PITX2 A reverse complement after artificially methylated at Cp[AT]
tctgcaaaacagaagagaaggaaggctgtaagaagtggtggttgttgagtgagcagggctcagatgagactatgttacactagctgttaggtgtctactgtgtgctaggcttcaggtgtgtttttttgatctgacagtctctggcatgtgcagcagcatcttcagtctagtcttgggttcaggacatttatttatcaagaggggatctttcttcagagttgttgcaaaagtgttcagaggttagaggactataaagtcacagtgtgctggggaggctgtggatctactttcaagaatcttggtgttggggttaagaactcatctgaatgcaatggcagtgggagtgggtgggtggagaggacttttctctttgggaagctgtatgcaaagatcattcttcagtgcttgttcattagttggagcttggtaaacatttgtagaacatcagtgtcaatgtgtttctgttctagacagcagtttttcttggttttctgtaattctgaaatgaatgggctcttggtctagggtgtttcaggagtgagctgagtttgggtctctcattcatcaggagtcactttttcatatttagtcacactttcttctagagatactaatttggtcatttatttacttactacaaataattattctaaagtatgatttaagattgcagaggagagacactgggtggactgagtgagactgaggagagcagggcaaatgttcttggagggtttactgtttgtcaaggatggagaaatagctctggtataactgctattcagttctttttctttctcttttgggtgagtcaaatctttttcatgttttcaatcacaatgcagtgagtcaagcatttaatgtgctttttcttctctgtcacaggcaagttgggagaggtgggtcttgaggggcttcattgggtgggtagaagagttgtggttgctttaaagacaagaaaagaaggttcagggctttctaggtttctttgatctcagtgtctgtctctcttcatgctaatcagggtatgttgatgattggagggttcactttgtgtgggtgtggggattggggtgggagcaagtgttgttgggttggtggaggcacagaggtggggcagggagctgtgggtctgtctctggtctgagtattgtttttctgtgtcttggtctcttctgaagggagctgggttctggggagtctctggtcaaggttgctgtctacaggaggggctgtttggtgctgtggtgtggggattcagggtggggatggtcaggtggttttttcatttgctagtgagaatgtgggtggggactctgttgatttgattcttgtgggtttgtgggttcagaagtagcagtttggtggcttcagatttagtgattctgcagtaaaatcacaggattagtttctgattgagatgtctgtttgtgagatattacaaaattcattatcacagctttctactaacttgatatgaagtaacacagatgggattttattagttcagacttcaaatgtttacttatgataattttggaggaaatttgcatgtcatcatcattttgataatcttttttttttatatgtctgaactggctgcattattagctggtagttggagcactgcagatggtaactgcaaatagtttttatttatttattttttttaaagaatgaaatatacaaaagaaaaagattgtgttgcttggtgtaaagtcagtcaattattacacattctttttttcacttttttgtgcttcagtgctgaagatcaaacaaagcaatacaaaacaaatcttcaagaactcatagagcttcactctaaggactgaaaagaaggtcaaggtgtgtttcttagctcacttctacatgttcttgtgacttggagatttattttgcagtcaaaatgagtcttgagacttgcatttttatgcttcatttaatgatcaggtctactagaagaactgagtctaaataactggggaagataattttttaaaaagagatcttcaatttttgtctgctgattcttaaacttgttctatcaagacaagtcttctgtgagaaatttggctgtcagactttggaactggcttcaatggctaatctcacaaattgagatgggagactttttctgatgggaggtagttctcattttcaaagttcatgttctagttggaatgtatatgtcaaggactcttgttttggtcaacttgggttttatattgtgagcacacaaaaagcactacatggctaatggaggatgaggaatcatggcaaagcaggcaggcaagttctaagaaataaaacaatttgctaaaaaataatttctgatgactattgcaagactgaaagtgcaggaaaaatacagtttgaataatttcagattctttcacattttttttcttttcatacactttgttatttcataacaaaatctttaatggaaagtttaaaaataaacagcacaggaacatgtgttttaaatgaactaaattgtgaaattagtcagtaaattaatttgtagtaagtaattatttaaggaaattaaaatactgctcagttcagttctgtattttatcatgtgtatgtgttctttacaatcaattaatataagtgctttaggaacatttgaagacaaacatgcttaacttaaggaacaaagcatctaaataatttaagtgtaattttgctgagttaaagtaaaacatttcacaaatgaagtggctatttaattttttagggaaagtttggttattgaaatgttgtatgctcatgttacatcaacaaaaatcttcaatttattttgcttatgtgctttgttttcttgatattattggtatttgaattttagatggatttctgtcaaaatgatattttgtgtgataaaagcatctttagttttgattgatagactaaaacaaatgcaaggaaatttctttaaatcagattaatttttcataaaaatattttagaatgtatgaattctgatatttacatttataatggtaaaagttttttttgtttagtttagtaagacaatactcacacaaaagagtaaaaaaaaatcacatcatcttatgatagtttgatttctaaattgcttaagaaagtaaagtggttaaactggaaaagaggaacatattttggaggtttagaattgaaaatttttttcttaatcttcagctggaaaataattctctgcattcatttaaagtgtatcttctgaagtgtcagattggagttgactggtgatcaatttaaaggagttacaattcaaagaaatggtgagagcttggcattcaggtctggctttcaggtaatttgcttgggtctgagaggtcactaactgtcagttaagatggaatctttttcttttcttttttttttcaatggataacaatgggaagggggctaatctttcagtagctgaaactttgtattcagttctttatcttgagaatgctaattcttggtttgaggatttgtttctgcagtgttggcattgagatttaagggaagatatcttgttttaaatgtcagtcatggtctggcttttctcttgacttcagcattctgtagattgttagtgtctgtggtgggggatgaaaggaacagggctttgcaaggtctgtttgttgactgtgttatcttgggtgaaacttagtttcaaaagtcacaaatcatctatggtgaagattctttgaagtggaacaaattttcagacttgcattatctcacatttctgtgggatagatggtcttcacttattggctattgggagagagctgctgtctttgtgtttcactgctttttggggtgattttcagtgagttgagtctttggctgcatggcaagtgtttgaaagttgggtctgagaggactgcagggcttctgagggtgtcaagttttgaaggagttcatgggtgcactggggtctttgaaatctagttgtcactggcagtttctttctgcttctcttcagctttcttgcttggtcttgcactctctcttctctttctttctctcatttctctctcttttctctgcttctactttgtgtggggagtgatgtgatgtcagcagagatttcatcaaacttcactgcacagtggtgtgtgggtgttggtgagtttgctgtgtggctggtgattcaggagtgagcacagtgtttgggtgagtgttggggggagtgagcaggggtgatgagaaatgaggcaggggagggaagcagatgtcagtgggttgaagagttgggagttggagttgggagagtgaaaggagaggggatctggtggggcacttaggagtcaattgaggagcaggagcatggactttcactgtggaaaggaggatcagaagggaggatgggatggaagagaagaaaaagcaatctgtgtcaatttggcagttctaataaatcaaagggggagtgtcagggcagtggggagacagaaatgtacttttggggagcaaatcaggatgggctgggaggaagtgacagggaaagtggttcaagagatggaacaaaggacaatgttcatggggttgtttgggatgaggtgtgtggagtgtgggtgtgagtgtgtgtgtgtgatcttctttcaggtctgcagagttgaggaaagaggtcacagcaaagagggactgtggagggaggaaagtgagagattggtagagggtgggagtggaggtgggtgtggtggggatgggagaggatgagtgaagagaaatctagaagaatggagtgagctagtgggagagggtgggagggtcacagttgggagtgaatgagctaggcttgtcagctggggaaggttgggatgctgggttcagcttagctgggacattgtgtttgaggtcaaggtgggtggatcaggcatgctgagagtgttggtgcacaggtgggcatggtcatgcactgattcagtgttcatgaagggtttgcactggacaaggctcagatgctcatagagtctagaattttctctgctgtatctacattcaacaagttcattctgggtcatggatatctcattttttaaaatgatgaggttaaggtttctggtgaggatggtattaaattgcatgggatagaagtgggggtgggggagagagtttttctcaagttcacatttgcttctgcaaagcaaagagtatgtgaaattacagggcatattctcacttgaaaagtgtgtcttacttctgaattctgattttctgatttcttgacttgagcaaagatgtgtattttggtagtgagcagaatattttggctctgttctgtctctgagtggaaggactataaatataatttgtctggaggatcaggtgtgaaggcttctgtcaggcatatgggacaatgttttttcaatctcaagggcattctgttaatgtatgtttttggaaagtgttggaacacagtcattgcttctggatttggattttttcatcaatattaatttctgcttgagagcaaaactcaggtttgctattaaaaagacatctctttggtttctaattgagaataaagttttctctaaaagttgtattgctctttctaaatcaatatatcaatacttgcaattttagaaatatatagtgacttgggagaatgtgcataaaatagatatgtttaaaaaagcttggtgcttaaaactaattctagtcactatataggtgctgggctttttctacttttgggggctgtctggaacatgttatgtgttttcttgaattactttgtgttttgaattcatttgagttagcagtaaaaacaggcaaacaaacttgctcaatttgttttgagtgctaaatttcttcactttgaaatagctaacagttgacagatggactcattttatggaaagggttagtctcttcagtcatgaagaaaactgattagagatctacattttaagtcatttctaatcttcatgtaacatttgtgaaaactcaaactttctctctttattcagtggaaactcaaagcagtgttatttaaggggagagaaatgagggggaaaatgttcatgtgctgtttaattgtattttctctctgactctgagaatttctatttctggtttttgaaatcttgttgaggcaagaaaatcaaatttcttcaacaagtttcacaactgaactctagttacaggacattggaaagtgcagtttgagaaagacatcttcatctctgttcattgatgatttttgcagtcttttcatttctctgagtaatgggctaataattctttctttttttcttttcattttgtagagattaagaggtgcttgtagcagaatggtcttgtcttcagctggtggtgaggataggcaatt

SEQ ID NO: 54 - DNA, 9001 bp, Artificial Sequence
  Bisulfite treated of PITX2 B reverse complement after artificially methylated at Cp[AT]
tgtaaagtgattaggagattaggagaatgttgaaacttctgctggaaaaatgcaaagaaaattctcactttgagtcagttgtttacagagtcagtgtgtgtgtgtgtgtgtgtgtctgtaatataaaatggatgtgaatatatatatacaaatagatatggttttgcttttactttaatctgaattatctagataattgtctttattcatcacttgacttcaatgggttcacacaaattaggacatcttatctttttaggcatctaggctgctgctgattttcagtgctttcaacatcttgcacatgttggcactatgaggagcagtcatgtgttcttgggtttttcaatcactttggaggctgattgaggttcttcatacatgtatatttgttgtgatgaaagtttcattggtagagtggagtcatcagagcttttatcaaaattctgtgggtttatgagagatgggtttagaaatctatatggctctgtggggcttcttggctttctaaaataaggcattaacattcaagctttcaaaaatatttgcagctctggggtttgaatcttgaaaaacaaggagtgaggggctgtgtatactaactacagtggagatttttttcattctttaatgtgatggagtttcttcatgaaatgaagctttaaggggcatggtattgtggggatcacagctattctgaggtttaaaagaagaaactggaatatgattagtaaacacattcagcagaaaagagctggattcttattgacttagttataggtcattggctggcagtgcaatgggaggaaatatttactttacacatatactttatgatcttgggggaattagaggaaattcaataagaaaatggctagaaacatttaaaattcttatttaaaagacttaagcaaattagagtcttatcagattaaaaatcactacaaatgtaagagcattgtcttcagtgaaatgctgtggggtctgagaaggagattctttgtcaaatctttgggataaaatgtgtcatttaagcatcagataatgagcagaatgtaaattaatttaatcttctttatcaacaggctgctagtgtaatgtgtataatttagtgataagattgcaggatctaatatagctggatgtatgagtctcagctaatgcagatctgtcacatgaggatgtgttttactctgagcaggtgtctgtatgtgtggaatggggtaaagtggaataaaaggttaaaagcagaaatgctgatttaaagcttactatgaagaaatttctttcttgcagctaaattattcttaaagtgggatgatactggtgaagaaagactgaaaaacaattctcatgtgtgtctttggactgcaagtttaaaatggggaggagttgcagatagggtttgggggtggtcagggcaaaggagagacacataagttgcaaatatatttgtagtctgcttcattcactttgtttcacattgaataagtttttcaatcttgtgaacaaggacaaggagggagtgttttaaagatacttcatgctggcattgcaaatcattgactgtaatgtcaaacaaatacacattcagagatgataacactaacttcatagtaaaacaattgttcatgcagaaattcagaggagattagtttgttctcttcagctgatctatgctgggggacaaaaggactttcaaaaattattttgaatatgtttggatttctttctttaatttctttggaaattaaatttgcttggaaacagtgctataaagagttgatgtcttcaaaggtgattttttttgttttatataaataaggttttgcttttgctagttgagtgcagttctaggctttttgttcttagctcacacacatttcttctgtctgcttggactttaatggctcaagacagtcttgagctcactgggaaaagaaaatgactgttaaaaattattcttgaaattggttatttggcaacattcttaattgtatggaaattcattaaggcatatttcatatataattagctcaaggttgttgattctacaggctttatggatttaaatctgattgataataaagtaaacaagagagttgaatttaaagtgtggctctcttgggttaggatgagcttaatacagtgtacaaggaatttgaaagatctaggatatgtgtcttaatcaatgttaagtagaatggataagctttcagcattttgaaaatgctgggttagggtttctcttctattgtgtgttttctgtctggggactaataagcatcacagagaatgtgatctgaggtgactttttattcttgtataaattcagagtgaatcatcaaacagttgtttgtttaaagtcaaggtaattttcttttgatgggttcatttgcttcttgatttctaatttattagtctgtcttttcagggctctgtcttctttgcaattaaagcttcttcagattagtgcagcattcacttgacaggctgtttggaaaatttaagattggagaggtgatttgttgctgtttttcaaattttctagttttaagtaatgtgtcttctttttatatggggtgggggattggaaatggatgtagtgagacacaaagagtgggtgtcttgttgattcttgtatctttctcttcttgatcatttcactctcttctttcaagtctttgacttctagtctcatctcttcatctttgggtttgtactaaaagttggattgtcttgggctgggcaggagctgaatttttgggagcttgtctgtgtagattcagtgtgcatggtgaggcagtagtttggttttgcactgctgataggtgcaggcaggacagtttcttcattgtggcttggggtgttctgattggtgtggagtcatgtcagttgcatttggagaagggtctgggaggaggtggaggtggagagggctggggagggttgtggtggagtgatgtcttggcatcaggaagtttgtctctggttttaagatgttaggtcaacagggaagtgtggagttgcagatctggtttgttgcttgtctgggtgtctggagctgagctgtggcaaggtttggcttctgtttgattgtttgaggggtgtgtgtgtgtgtgttgtggagggtgtgctcagagggttgtgttgtggctgcagtggctgctgttgttgcaggggatctaatatcatctatctgtttctgtcactcttgacacttctctgtcagggctgttgtgtggggggggggtgggcagagtgtggttggtgttagcttttcttattggaggggttcttgggggagggagggagagaagaagggggtctttgttcactcttgttttgctttggagcttggaagtctgctttctaaagatgctctgagtggtgttcttctgttcacatttcatgtctttgtttgtttgctgactttttgtctttggacttttttgcttgagtcttttggaggagatgggggcagcttggcttgagaacttggtgggggttgtgttttctggctctttttgcagtggggaaactttgtgtctagagtgtgatttggagtgggcagtggtggctatgggggcttggtggggcagtagtcaaggactagtagagtgttgtgctttcttgttcatgaactgcatgaaaggtttgcttcacttggagcattgagcagtggggatcaagctgttggttgtcttctcatctttctgtcatcattttcagttgttagtcatggctttggttctggcttttggtcagttttggttgctggacttcttcaagcacaggctggaggtgcacatcatctttgacatcttcagtttggaggttgcaggtaaggtgttgtgttgttctgcagacatttttgctcagctgctctgtgtcatttgctttctcttgtttcaaggaagtcagtttctttggggggaggtgtggtgggagtggttgtttgtctggctttttgcagaacttttgggagttggaattttgactattttgcatttctttagttctttcttgattggtttggcttctggggtgctaagggtgtgagcaattctgttgttctctctatttgtattctggtctttcttctgttttctgggtcacaaaaatttcagcatcttgatttgaggatcttcagaggttgttgatctctgtttctgtttttctcttggctttcagcttttgaggagcttcacttgttaggaaattgtctgaaatcactcagaaatgttctttgtgaagaggcattttttttttttttttgggaaagggttggtgaactttggtgttcaattgaattttcacatctttttctagtcttttcaaattgcatggaaatctgagctttctgtgagggggaggggggtctgtaaatcatgtgtgtgtgtgtgtttcaggagatttggtgtgtctgtgcagaggtgtataaatatacttgaaagcacaggctataaaagtgaatgtgttgctgcagtgagataaacatgtaaataaaatgtgtggtgctgggggaggggaggaaatggggtgtggacattcacacttgtgtctgcacatttcacaggtgcagtgcttcttgtggtttggagttgttgtgtgcattcttctttggtgtcaggcagttcagctctttcatggcttctgttgttggttcagttggtgtttgtgttgcaggtgggcatgctgatgggaaagtgtgtgtgttttgttttcagagaaagataaaagtcagcaggggaagaatgaggatgtgggtgttgaggatttgtctaagaagaagtggcaaaggtggcagtggactcactttatcagtcagcagcttcaggagctggaggtcacttttcagaggaattgctatttggacatgttcacatgtgaagaaattgctgtgtggatcaatcttatggaagtttgagtttgggtaggagtcagcatggagtctgggagggatggggggaggatgttgtggaggtacaggtcaagtagatcaggagagaatgtggaaggcagtgttgtctgggagggtgttggtggggtgcagctttgcaaaggcagaaggtcttgtggtggtctggttgtgagattacagttttctctttgaggttgacaggactgttgttctggctcaggctttcagagtggcattggctcactgttttgtcattttgtgatctcatgagctgggctgcatgggcaattttctgcacaggacattgtgtttctggcttgcagttgtcagagcagagctaataaaatttctatcaggtcaagagttgtgaacaggcttcaatctgtgagtctttaacaaggaaaatttgtcagagacatggaagagttggttctttctgggaaatctttgttttggttctggttcagctttttttcttctgggcttgtgcttcttacatcttctttatggttgttttggtcattcaggtctctttcacacattctattttctagttttgtgatctttgggagcaaagttttaatacacaactactagttctcttagaaggagaaagaaaaaaagaagaaagacttttctgcttggtttatttatcttctctcaggagttgaactctggaaattgaaactcacattttctcttctaaattataatcatagttttgtaaaaagggcttatcttaactttgtagcaaatctgtactttatggattggcaaaaatgagctcaaataaataattcaatagcaatgttctggtttatgctggttggtggaagatttcaaatttgttaggattctggaagcagaaaacagaatcaagcaaatcaagtggcattcagaggctttgctgttaaaaaaaaaaaattaagtgctctgggtagaaaaaataaagtttttggttagagcagagcaaacaaaaagaagaaaacaatgataaaaagaataaagatcaaaatgctctttcaaatcagagggaatgaagacactctctgggtggcatttgtgcaaggcatgaggctatgctggtggataaaaggttgggaagaagttgaaaatggttttagtttaactgttcagagtcagagctgggttctgggtggtgtggttttgagcaaggtcagtctttcattagctctcttgcacatcaagggaatgggtctctcatgtactcttcttgtctgagcaaagtttagatggtctagggtagaaatggcaagtaattaaagacagagtctatgggttttctgggattctttgaaaatgttctttcattttgtttgctattttgcagcttcattctagtgctttgtagttgtggtgctgggctcttcttgcagctgtctcttctttcagggtggctgcttgttgagtcaagtgggagtgaggtgtgctttttatagcagttgggtgcaaagaggaagggggataaaaaggaaatcaagaatgaaaggaaaaagagaaaaagtggattacatggctgggtttggtggagatgtgtaatgtgaaacatcactggtgtcagcttggatatctcaggtcaggtctctcttcaatacacaaaagttgttgtctggggtgacagggaggtttgatgtggattgggattggggttgtggctgggtcattggacatgggtggaagttggttggtctgggtggttgtctgcaaagtcaaatgatttggctgggtctggtgtgtggacaggtctgtggtgggcttagggtaaagaagaggcagagtgaaagaagggggaatcttcaaaactattctttttgggtttttggagtttaatatgtcaagcttctggagttaatgagctgatgaagaggtggtcttttgctctttatttggttgttttgctaggtgagaaagagtgttggtggtctagtttctgttaagggagcatgtatcagggggtgggggatgacagtggaggtcagggaaggaagggaggaattgtgtgggagaaagagtgattctctagtgttctttcagtttcttcttctcatttgtgggtctgtggctttggaatggaagcaagtttgcaaggtgttttgggaagggttggaaaagtctgctgttttgtgtttgttttacattaagtgtttttggatctggagaaatgtctggctgagtgatcaaattgtttgcaggtcttcatgtgtttggctgaggtttgtggtgtagctttgagtttcagcttgcaggtcagagcagatcaggtcttctgtgcttggtggagatttgggtcagtaactgaaagctggttctggtatcttggtgtgcagggtggtgcagtgaagtgaggtcagggtgtgtgagtgtgctagtgtgtgtgttgggggaaggtgggggttggtctttgatggaagttttagtaatctgcactgtggcatctgtttgctttcttgtttcaattgttttcaggtttggttcaagaattgttgggtcaaatggagaaagagggagtgcaatcagcaggttgagctatgcaagaatggctttgggttgcagttcaatgggctcatgcagttctatgatgacatgtattcaggctatttctacaacaactgggttgtcaagggtcttacatttgtctttctattcatcaagagctttttcttcttcaactctatgaatgtcaattttctgtcatcacagagcatgtttttttcattcaactctatcttgttcatgagcatgttgttcagcatggtgttctcagcagtgacaggtgttttgggcttcagtctcaacagtctgaataacttgaacaatctgagtagtttgttgctgaattttgtggtgttgatgtctgtctgttcttatgtgttgttgacttctttgtatgtttatagggacatgtgtaacttgagtctggtcagtctgagactgaaagcaaagcagcacttcagctttggctatgtcagtgtgcagaatttggtcttcaatctgagtgcttgtcagtatgcagtggattggtttgtgtgagttgcattcacagtgttgggattctaggatcttgttggatggggcaactttgttcttgaaagactgggaattatgctagaaggttgtgggcactaaagaaagggagagaaagagaagctatatagagaaaaggaaatcactgaatcaaagagagagcttctttgatttcaaagggatgttctcagtgtctgacatctttcactacaagtatttctaacagttgcaaggacacatacacaaacaaatgtttgactggatatgacattttaacattactataagcttgttattttttaagtttagcattgttaacatttaaatgactgaaaggatgtatatatattgaaatgtcaaattaattttataaaagcagttgttagtaatatcacaacagtgtttttaaaggttaggctttaaaataaagcatgttatacagaagtgattaggattttttgcttgtgagcaagggagtgtatatactaaatgtcacactgtatgtttctaacatattattattattataaaaaatgtgtgaatatcagttttagaatagtttctctggtggatgcaatgatgtttctgaaactgctatgtacaatctattctgtgtataacattttgtacaatattattgttttacttttcagcaaatatgaaacaaatgtgttttatttcatgggagtaaaatatactgcatacaaattggtctggattctttcttttcttctctgtcactaacttggtcaggacatctcagtcactgctttctaaacaaatcagttttctctgtctgtctagttaaacatacaaggcagcagttcttatttaaatttggtagaaataaatgatagtcattcatcagaaactaaaaagaaaaaaaaaggcatttttgggggggaaaagggctacaaaatctaattttgtctcttcaatttttctttggcttaaatctagaggatttcattatggctagcaaataatatgaaaaagaaaaaagaagaaagaaatttagcaagttcatcagct

SEQ ID NO: 55 - DNA, 1920 bp, Artificial Sequence
  Bisulfite treated of RASSF2A reverse complement after artificially methylated at Cp[AT]
tgcagggttggggataggcatgtgagggggagaactctgagtagatagggaatctgcagttgggctgctcaagggtctctgtgtactgggggtgtcaggaggttcagggatggaaaagggggaggtgagaaatggacaaagaaacttggtcttcttggcattgctgtcatgtctggttggtttgtcaagttgaaggggtctgtttagtttctgtttggctcaaattcttttgggaataagctgggatgttagaaaaaacaaaatttcacaatctctgtctggggaattcaggttgctggaggtgggcttggtagggcagtgtgactgttttctgggagtggctgtcacagctttgggtgaattgaggagcttgggtcaagtcttcatttctcttggagagggcagcagcaaggaggtgaggggagtcagctcattcttttcaattctgcacttttttttcatcttttcattttcagtttggaagaattgctggtggtgggagtctggatgagctggtggggaaggggatgcagtcacagcattgtctgggagggaggggagaagctttgtttctagaggggaggggagaagaggagggggcaggagacaaggggaggaagaaaggtgaaggcaaggtgaaggggtggagagtgatatgaagagtgagagaaaagagaggacagtggatgagcagatttggtaggggctgaaaaaggtcaaggggctggagggagggagaggaaggaggaggggagtgaggagggtggggtgtttggttttcagttgtgtggtcattgtctgttcagtctggctggatttgagtttggtttgttgattgctggttgaggtgcagctgaagcagtttttcagttgtggtgttttcacttttcaacttcatggtttctgtggtgtgggtgtgatgcagctggtttggggtgaaggcaaggtgtggggtgtggggtgtggggcactgggagtgaggcactggtgtgggatgtttggtgcaaggtgcagggtgtgggttgctctctttttgtgttttttcatcttgtcaaagttttttcatgatggtttctattttggctgggtcagttttgtaattcttgtctgtctcttgtcttctcttttctttttgagttgtggggcttttggggtgtgtggatttttgtcaggggttgtgtaggtgtggagtttcagttggtctgtcttgggtttgaagaaagttgtggcttggagctagttcttcttctatgatttctgggggtgttctttcttctttttgagtttgtgatgggaaggtgctttcatttcatttttggggtctctgagactttctggtgaggtggggtggtgtggcaggtgcagggctggggagggtctgacagttctggagagtgtttgatttcagtttgttgttgtcttctaggtggatttttcagaggcaggtttcagtttttggtgtggggaggtggtgtgcttcagaggggtgcagggtgtgtgggggttgttggttctttgggcactttttctttgtggtctttttgttcttctttggagctggtgtctgaggttgctgggatctcagtctggtgtcttctcttgttttgagtgaggcaggtgttgtgggtggttttggctacttctgcattttgagtgcttactttgcattcagctctaagttggagagctctggggacagttgagagtgtcagtggtctcatagggagactgagggttctgtttcatcttgggtgttgtgtgggtctgggctgttcacagcatctctgtgtctcagtgataggagaagtcaagtgtgaggtctctcaacagctgtgtgcactctatttttcaggtatctggaattttggtgtctagaatgtgttttttgggagagcaaaggctgtgtctatggcagtctgg

SEQ ID NO: 56 - DNA, 5473 bp, Artificial Sequence
  Bisulfite treated of SHOX2 reverse complement after artificially methylated at Cp[AT]
tttcatcttctgtttcattgatgtgttattattgggggggctggagcagtaaaaaaagaagaaggaaaaaaagagtggggctctgctggcagaggttgagtgttgggctgatgtgtggtggtgatggaagaacttatggtgtttgtcttcaagtcttttgatcagaaagtgaaggagaagaaggaggtgatcatgtattgggaggtgctggagagtgggttgctgtgtggggtcaaggagttgattggctgcattgaggtgggttgtgatgattgcagcagtttggcagtttgggtggttggtggaggtggtggtggaggaggtggaggtggtggtggaggaggtggaggaggtgtaggaggaggaggagcaggtggaggagctggaggagggtgctcttttgtttgggagctggacatgggtgttgttgagagaagcagggagttgggcagtttgtgactgatggagggtaatgatctgactgatttttggcagtggtttttctttttgtcttttggacttctcttgggtgggagaggactttgaggttcagtggggaggggagagggacatggagagggttctggatttcagctttgtcagctagagtgatagtggaagggtgggggtttggtggtatgcttggtcatgggtggggttctagtgtgttgtgggggtggtgtggggggaagtgtgtggggtttgtgtgtgttcttttcagatgttttcatttcattgaaatgcatttttcatcagtgggaggatgggtttgcagtttggatggtttgcaggtggatgtggaagtttgtggggttgggctgcaggagggggtgctgaatcagatggtgggactaaagctagtctctagtgcagagtttgttgggagggagaaggggcagaggtggaaagcttaattctttggttgtctaggtgtttggggttgtcaagatttcttgaactttgcagagtttctgaatctttggatcttaggggtcaaaacttttcattctctttcaaggtagaaggaagtcaatgaaagctgaggttcaggctatgctgcttcttttgggtgaggtgttttggtttcttggtgtgttgggggtggggggggggggtggtgggggaggtggggatctatatttacacaatttctttagtgttttcaatcattcagtacttggttctcttagagcaaaaattctttggtgctagctcagtgttaggaaatgtctttatctcaatggcagagtgttctatatcaattcaaaggagttcaacaataaaattgatttggcacttggtgtctgcagtaactggtgtactgtcatattttttcaattaagaaaatatgtggcatgtgtggaatcacatatttaagcaagcaattaagttgtttatgacatggtctgtttctgtttagatcagtaattggaaatttggggacaaaaatagagattttattaagtctatggatcaacttgaaatttggacatcttcttgaagtttcaaaactttgagtggcattcactgtgtagatgacatgtaatagacaaagtcttttcatctcattggcagaatttgaagggtgtgttttcatatttaaatttcaatacaatatcagtaaaaatactttgctattaaattggttcataatgtttactataatgtttctttctaaagaaaggacaaatgttcacaaaactaactctgagaactagaaaatatggcaatatttaagatcattgtagctagaatgtttggcagggttgagatctagtgactcttctttcttcaaatcagcatcaggtctttctaaatttgtaaagtggtggagttattgtcaaggtgttcagtgcagtcttttggtcatgagttcacaactacaggtttgaactacaggtttgtcagtgtgtctgatggtgaggttcaggtctgaatttttggtgggtgcagtttctgggattgttgattttcaagctcagggcaagtattaatttctctgcagattggctcttttggaaatgatttttaacattcatgctggtctggattctgtgctgggaagaactgcaaacagtcttgactatctaaactcagctttgacttcttaaaatttggagtctctgatttgggtgcagaggataaaggtttcagggggatatatatatggtggctgtatatgctcacactagaagagcttctgtttttaaagggaggagaaggacaggaaagtggcaatggatgtgtgcaaattcagagcagaaaaattcatattttattaaacatttgagctgctggttgcatgaaaaggctttgagcaatcaatagaaattgaggattgtgaatattttgcttgaatctgttgatctctgtgggttaagtgtttagggttgagtctgtgttttcatgagggagggtgaagagagaacagaaagagtggttgcttttgtttgtcattggaggctggttttttgtcttctgtcttctggtttggcttgggtggtgagttctttgggcagtcaacatggtgtgggtgtctgtgcttgtgtgattttggttgggcaggtgggatggagattatctggctgttcaggggatcttatgcagggtttggtttgagttcaggggcagtgaggggtgtctgtggatgtggctttctgtgtggcacaacattggggtctgttgctcttgctgatatcttttggttcaattgtttctaaattagatcagcaagtttgtggtaggcagagagtcagtggtggtgagagctggtctgagaatgagtcagtcttctgggaatggttggtgtgagaggtcagtgggtggtcttgttgtgttcttatgttcagactttgctctgtgagaggtctggtgctgtgtctttgatttctgtgagtgctgtggagcaagtgagtgtgaaagtgagtggaaatcatttggtgtttgctggggaaggttggtgactggggggtgaatagtgaggtggtgagttgaggtatgtttgtgaaggaggtggtggatgactgttcatcttgtttcaggtggttgctcagacttgatctttgtgcttctttgggatattctttctttgggtgggttgagaagttggatcaggatttcatgagggggaaggattctctattcttttttgtgacaaatctggtaacaggatttgctgtgctgtttttgtttgtgtgtgtgtgtgtgtgtgtgtgtgtttgtgtggatgcatgtgtggttttgctggggtgttttcttcagtgtttttggagctgaaagattgcaaagaggatgtgaaagggatggaggatgaaggtcagatcaaaatcaagcagaggtgaagttggatcaatttcattctggaacaactcaatgagctggagaggctttttgatgagattcactattttgatgtcttcatgtgagaggaactgagtcagtgactgggtctgttggaggtttgagtgcaggtattcagctgtcaggaggttgagggttcagggagcagagagagtctggggttggaaagaggcttgggggacacacttgggaggtggtgcttctagtgtctggtgtaagatgagaaggaaagagatatctttactagaggtcttatttttcaaagtagatcttagttctatagcacttttcttctttttttttttttcattctaacatatgttttcagaagaagaaagctgtgctgggctttctttcagagtttctataaatcacatttttcttgtcttgcactggctttaatgtggtttaattctaatgggtctacttttataaggcttaaaaaaaaatttcacagaaaatgttttatctctggatgtcttaaaagtttcaaagagtattttgttctctggagttggattttcttgaaagtctgctctgcagggtctaggtttgtcaagtggatatttcaattaggtttatagatgtgcagactataaagaaaattagtaactgttaagtgcagaaatttacagtctgctgttagtggttgatctcaaactgtgtgtgaaatagtggagaaataaatgcattttggtcactctttgttcattcatttaatcaaggcaatgaaactgattctaaatacattagattttaaaacaaatcacatatattagtatttatattttcaaagtctgttcttcagcatgtgtcatattcaatgaagttaggactgaaacagattttctttattggttgtggaggcaaatgtaatagcaaaaataggctttgggggcatttaaaggagcaaattgtgtacattcacatacacatattcttctagctttagggggaacaaatttaaatgtttcagattgtatttttgctcagataataaaatagaataaaatgatagttattattggtttgaacacatggagcagttttaggtttgcacatctgcagctgttacaaagtattgctgtaacagatactcttttggtctctgggcacagagatcatcatctgtagtgaactatgcacaattcttaaggggctttttcacatcttgtaacaggatcaggaaaaaaaaaaacagagcagtcatgttgaagaggaaaagtaataataggctgtcttggtcatcacagcatcagcagcagagtctttctttttaagtctcttctgctttgctctgtgcactgagatcttcagaggctcagcaatttcttaaaaacatgatgataattattacagttatgattattagtatcttaatttcaactcttctaggggaaaaaaaggcaagaagtctcaggtcatgtgaattacacaaaggatgtcattctggcacaaaattcattctctgttgtactaaatagcagagaaatttttgaagatttacattgactatgacacttgctttcaaaaacatatcaatgaaagctctgaagcagtatttttactttaatggggttttaaaaactttaatttgtgagtcaatcaatatgctttattattgaaagtggaatacaaaagcaagctttatttgaattttaaaaaatctgtcatactgtctgtaaaagttgtcaagtttaagcaggtaacattcaggagaacaaagtatctaagagttacttgctttatatatacttcattcttcttttgctgagtgctcttctttttttctcttaagaagtgaactttattgttgtttcatacttttatttacattttagttattttctagatgtttttctactattctaactgcaaacagtggctttttctaaagaagcaaattagattatcatgataatggtgcacaattattctgctactgtgtttcactctgctgcacagcagaacagagaaattctaaacttctttgtagtgaggcttttatgacactaattatctcttttcaattcttacaacttcttctttgcaaaggagtcattatttgctctggtgtttggtttttctttaagatgaagctaattaacattat

SEQ ID NO: 57 - DNA, 1405 bp, Artificial Sequence
  Bisulfite treated of Septin9 A reverse complement after artificially methylated at ggcC, agCt, Ccgg
gtgggtggtgttttgagtgtaaaatgtgaatttgagttgttaagtttgggtgttgttggatggttttatttggaggtcgttttgtgttttattaagtagaggagaaattgaagagaatttgaagaaaggatgttgtggtctggattattagttttagaggttgaatttaaggatatttttttatttagttttgattttatttatttatatagatgtatagggatttaaagtatctggtcgatttggaaagttagtgatttttgtgagggtgtaaggggtgaggaagagggagtgttttttagggtagtttttttgatatttgagtaagggttggagatagtgtaggggatggttggtttaggttgaaagtggtctgatagtggtcttgttttgggaggaatttgatttgtagtgtgtttgttgtggggatttgtttagctctgggggtgttttgttatttctggtcgtaggtatttaggtgagtagtgttggttctgggatattgatttttttttattctgggtgtgaagtttatttgagtaagatttttttatggtgtttttgtggtcgttgtttttaggaaagtgtggtggtgaggtagtggggtgtgtgtttttagggtgttaattttgggccggtagtaggaaggtgggaagagggggtggtctgttgtttggagtgtattgactgggtcttgttctggtcttgtttttgttttgtttttttctggagatgtgtatagaattctggtctagctggttgtggttttgtttttgatttgttttttttttgttttgtgaatgtgtgtgttgagttttatttttgtttatttttgtgttgtgttgtatttggtggagtggggttggtgggtgctgggtctgggagggggtgtttttgtgtggtagtgtagattagattagattaggtcaggccgggggtgggggtcgtttgtgtggtctgttgtgtttgtagctttgtatttttagctttttgtgttggtgttaatggttggttctgggagttgttgtattttttagttttgagtctgggtggggtgggtctggtcaggtggaagtgggtggaggtgtgggtgttctgggtggtcttgctgggtgaggtggtggtgctgggtattgtggtggtgctgggtatagctgggggttggagctggggtgctggtttagtgggccggggtagggtgggataggatatttgttttgttatttttttggtaattaaaagggtagagtgtgttgattgagttggagttttagtttttttatttgtaaatgggtgtgttggatagatgattatttgttttttttgtgttgggtattgtgtgtagcttggtgtattggtgtagtggggtagatatagggagttgttttttataatttgggtaatg

SEQ ID NO: 58 - DNA, 2365 bp, Artificial Sequence
  Bisulfite treated of artificially treated Q9HC74 at ggcC, agCt, Ccgg
gtatgtgtttaaagatgtttagatgaggaggtgttgtgggggaggggggtgggaatagtaagtttttttagctttgtagatttagattttttttttttttgggaagtagggatgtaaagggatagagtttgaaaaagggtttttattattaagctgataaagtaattatgatgtttttagcttatattttgtatagtgttagtggtcattggattataatttttttttgtttttttgttgttttatattttttttaggtctagttttgaagaatagttattggtattttgtttggtgtttagttaaagttttggttttttaggaggtcttgttttttttatttagatagggttgattttaggtgggtcgtgtgggtagctgggtttaggatatttagatgttagttttggttttggtcatggagtggggaggattttaggttggttattttttagcttggtctgatatttggatagtttgtttattttaatatagttttttttttttctggtctattagagggttttgtttaagttagtttaggagtttttttgaggggtgggggttttaggttctggtagaggtaggtctgttttttagaagttttgttttagagtgttggagattattgtgtgagctttttttttgtttgttgtatttatttttgtggatgtaggatgtagagttttagtactggtagttaagaggatgtaggaaagtgtatgtatttataggtttagagatgtggatgttagatttaggtttggatagagtagttttgtaagttttaatatattttgtaaattttgaagataggagagagttaaaatattttttttgtttgtatgtaggtcttttttgttttttatggtctgattttgggaggtggatgaggatatttttaggtctggatgggggtcatgggatattttattttagattttgttatgatttgggttgtgtttgtttggtgtttctggtctatgggttgtataatttggtggtcttgaaattggtgtgggggaggggagggttgtttatttgagtaggatgtggttgtttatttagttggaggtgaggaatgatttttttattttgttgctgggtttaagtggggtctgagagttgctggggagagttaaagggaggggattgatggattttttagagtgaaattgtgtgttttggagagttttgaggtagttttgtgagtttttgaggaggttgttgttgtttggtaaatataaataataataaaaggaaggaaatttaggtggtagtgtgtagaatgagtatagggttttgtgagggtgtgtagggtttatgtgggtgtttttaatagggttttttatgtaggtggtgtgggtatggggccgggggtgtgtggtgtttttagtgggagggtgtttggattaggggttttgtttttttttagtgtatttttgtttttttttagtgtatttttgttttgtgttaggtctatttgtagggttttttttagtatgtttgtggtcgtagtagttagtttagtatttatttttgaagtttgaaatgattttatttagctgtgtgttgattgtggggtttgatatgatggttggtgggtagtgggttgtgtggagggtagtggtgaggaagtgtttctggtggggtctgggtcttgtgtgttggttggggtgttgtgtttgtgtttttgtagtgtagagctagttgctggaggagtttttaggtcttttggtttagctgaatgaatgggggaggaaggtgggtgctggtctttttttgtgtgttgtgtttttgttttgtttttgttttctgggtggattaggtttttgtatttgtactggtctttttgttttgtattggttgttttgtttgtttgttaaggtcaggtctggggggttggggtctgagtggtcgttgggggatagttttgggtatatgactggagtgttttttttttttttgtttggtctgtgtttaggggatggtgagagatgtggtcttagtttttttttctgggtgttttgttgtggtcagatgtgggtggatgtggaggccgggtcatggtgaggagggtgggtgtttagaggggaagagatttttttttttttctgggtgtagggtttttttgtaggaggttgtatttgggtagttaaataaagttttttgttattgttgttgtgtgttttgtgtttgtaagggttaaatggtagtgtatgtggttggtaggtaggattctggtctgtgggtttaagagttgaggggtgtagggtgaatatgtgagttttatggtattagtgagaggtcattaatttttatttattgagggtatttttgtagctaatatttttattatgattat

SEQ ID NO: 59 - DNA, 4261 bp, Artificial Sequence
  Bisulfite treated of GSTPi reverse complement after artificially methylated at ggcC, agCt, Ccgg
tatttttttttgttttttttttttttttttttttttttttttttagtttgtgaggtttagtaaatatagttaggttgagggttttaggaagttattgattgtgttggaggagctgttttttagttttttgttttgtttttttattgattttgaggttgagaatttttaagttttgttttaggaaatatagtgtttatagtagcttttttagaaattttattggttttggagaaaggaaggtaaattttgttttttgtttagagtttttttaatttttattgttttttgttgttattgatggggaggtttatgtatttaggggaggtcaggaaggtcttgagcttgggccgggtattgaggtgttttatatatgttgagagtagggggaatgtatttaggtagttaggggttaggattttatggattagtagtaagtttagtaggttgtagttagtgaaggagatttgtagggtaggggggttagggatttagttagtgggagtaggttggaggaattgggggtagagggtctaagtttattttttaggtttgttttgttttgttaaataaatggtttatatttgtgtttatttggaagtagagggtggtgaggaaggaatagtatggggtcagatgtttatttggttttttataatgaaggttttgtttttttggttttgggatagtagggttttaaaaggttttagttgtctgggtagtgtttttatatagttatttttgtttgttttttgttagatattattatgtattattttatttttattttttttagtttttgagatatttttgtttgttttaggtcagatattagagttttagatttttttttgtttgttttttataattaggttagtattaaattttgtttattttagctgttaatttatttttattttattttgtttgtttatttttgttgggtttttttattagatgattgtaaaagctttagagctggtttttttggaggatttttttagattttatatttagatatagttttgtttagattttttaatggtctttattgtttttaggagattttaaattagtgggtttaaggtctttgggatttgggtctattgtttgtttatttttatttttttatttatttgatataaatgtaagtgtatatatatatatgtatatatatgtatatgtatgtgtatatatgttgtttttgttgaattggttttaggtttttaaatgtgttttgtgtttgtatattttttttagctaaaagtgttagtatttttatttagaaattggtgataaatttttttttatttttggttattttaggaagtttttgttattttaggagattagaaattattagttgttggaggtttttgtttttgtatttgtttttatgatttgttatttggttggttgatgttttaggtaataagggtgtaggttgtgttttgttttaggtctttgggtctttggtctagagctgatttagtttttgtattttgatttaagaaggggttagtttaagttatttgaggggtaaggggggtgagggtataagaagtttttttttttgtttagtttttagtgtttaattttggtgtagatgtttatatagttggtgtagatgagggagatgtatttgtagtggaggttttttatgttgttatttattatgtttattagggttgttttttgttggttttttttatagagttttggggttgggtggaggggagtaggtcgtgtgattgggtgtttgattaatatatagttattggggatgggtcaattagggggttgtttgtgagttttagtttgggaggaggggaagaggatgtgtgtggaaggatgagagattgttatatagtaggtgtttagagcttatttgatatttgggaggtagtttggtatagggtaaggattgtaggtatttaggtttgattttgggtaaattatgtaattttagtgggttttagttttttttattttagagggttgtggggtagctgatttaaataaaagggttctgggggtagaggtttgtttatgtttgttttggatttggaggtttaagatttattaagggtgtggtctaggtgatgtaggatggtattggattggtatagggtgaggtttttgttttggaatttggggagctgtttgtatagctgttgggggaggtatggtttagggaggggtattgagcttgggtgttttttgattttagttatagttttttaaggtctagtattttttttttttgtctgggtatggttatttatgtaggaggttttgagtgagtttttttgttatgtttttatggttattattttttttttttagctttggtcttgatttgttagtagtatgtgtagggtcgtgtagtggtctgtggggagggagaagtatgagatgtggggactgggtcgattttgttttgtagtaatctggggaggggttaggagtgtagggagggaataggtaaataggtttttttgaagattttatataatattggggtggggagtaggtatggtgggagaggtggggaataggaaggaggtctggggtaaaagttatatgatggagggataagggggtttggatttttctgggtgggtgaggggttgtgggttgtagttttagtttttgttttttttttttgttagatatatgtttttattttgaattgggaaatagattatggtgtagggtggtattgtagtgaataaagaaaagtttgttggagtctgggggaggatgttaaggtgtggtgagtgtagtttgttttttttttttgtttctggggttttatttttttttgaggtgttctgggtcttttgaaagttgttaatggtattggggatgttttgggttttttaggtctttgttctgggttttgaggtgggtgaggagttttgctgggagtctgggtctgatgttgtgggttggtcttatgttgggagctttgagttttatttctggggagtgggtcgtgtgtatttattggtggtgaagattgtggtggtgaaattttagtgaaggtcttgtggtctttgagttttataagggtggttttgttttgttttgttttagtgttgagttatggtgctggtcgtttttttggagggttttgtggatttttgctggtcttagttctggtggtcgttgtattctgggtgttggtcgtagaggggtgttttggagtttctggagttgttgtgtagctggccggggaagttttttttttttttttaggtttttagtggggtctagggagtaaatagatagtaggaagaggattgtagtgaagtgtgtgtagtgaattggtgtgctgggatattgtggggggaaattttttaagattgttgtgattctggagcttgtatatttgttttatagggtaggggagaggggtggaggtcgtttagaggaaaggaaattgttttattttattttattttattttattttattttattttattattttattttattttattttattttattttattttgtgttattttattttattttatgatgtagttttatgttgtggtctaggttggagtgtagtggtgtgattttggtggtttattgtaatttttgttttttgggtttaagtaattttgttttagttttttgagtaggtggaattataggtgtgtgttatatttggttgatttttgtatttttagtagagatggggttttattatgttggccgggttggttttgaatttttgattttaggtgatttgtatgttttggttttttaaagtgttgggattataggtgtgagttattatgtttggtcgtttaatttttatttgaagttttggggtatatgtgtaggatgtgtaggtttgttatataggtgtgtgtgttatgatggtttgttgtatagattattttattatttaggtattaagtttagtattttttagctattttttttggtattttttttttttagtattttgtttaataggtattagtgtgtgttgattgttgttatgtgattatgtgtttttattgtttagcttttatttataagtgagattatgtggttttgttggttttttgtttttgtgtgagtttgttgaggttaatggtttttagctttatttatgtttttgtaaaggatatgattatgttttttttagtggttgtgttttaggttattttttttggttttgttgtttattttttgttgatttgtagatttttatttattttagatattgattttttgtt

SEQ ID NO: 60 - DNA, 6343 bp, Artificial Sequence
  Bisulfite treated of PITX2 A reverse complement after artificially methylated at ggcC, agCt, Ccgg
tttgtaaaatagaagagaaggaaggttgtaagaagtggtggtcgttgagtgagtagggtttagatgagattatgttatattagctgttaggtgtttattgtgtgttaggttttaggtgtgtttttttgatttgatagtttttggtatgtgtagtagtatttttagtttagttttgggtctaggatatttatttattaagaggggatttttttttagagttgttgtaaaagtgtttagaggttagaggattataaagttatagtgtgttggggaggttgtggatttatttttaagaattttggtgctggggttaagaatttatttgaatgtaatggtagtgggagtgggtgggtggagaggatttttttttttgggaagctgtatgtaaagattattttttagtgtttgtttattagttggagcttggtaaatatttgtagaatattagtgttaatgtgtttttgttttagatagtagttttttttggttttttgtaattttgaaatgaatgggtttttggtctagggtgttttaggagtgagctgagtttgggtcttttatttattaggagttatttttttatatttagttatatttttttttagagatattaatctggtcatttatttatttattataaataattattttaaagtatgatttaagattgtagaggagagatattgggtggattgagtgagattgaggagagtagggtaaatgtttttggagggtttattgtttgttaaggatggagaaatagctttggtataattgttatttagtttttttttttttttttctgggtgagttaaattttttttatgtttttaattataatgtagtgagttaagtatttaatgtgtttttttttttttgttataggtaagctgggagaggtgggttttgaggggttttactgggtgggtagaagagttgtggttgttttaaagataagaaaagaaggtttagggttttttaggtctttttgattttagtgtttgtttttttttatgttaattagggtatgttgatgactggagggtctattttgtgtgggtgtggggattggggtgggagtaagtgttgttgggttggtggaggtatagaggtggggtagggagctgtgggtctgtttttggtctgagtattgtttttttgtgttttggtcttttttgaagggagctgggtcttggggagtttttggtcaaggttgttgtttataggaggggttgtctggtgttgtggtgtggggatttagggtggggatggtcaggtggtttttttatttgttagtgagaatgtgggtggggattttgttgatttgatttttgtgggtctgtgggtctagaagtagtagtttggtggttttagatttagtgattttgtagtaaaattataggattagtttttgattgagatgtttgtttgtgagatattataaaatttattattatagctttttattaatttgatatgaagtaatatagatgggattttattagtttagattttaaatgtttatttatgataattttggaggaaatttgtatgttattattattttgataattttttttttttatatgtttgaattggttgtattattagctggtagctggagtattgtagatggtaattgtaaatagtttttatttatttattttttttaaagaatgaaatatataaaagaaaaagattgtgttgtttggtgtaaagttagttaattattatatatttttttttttatttttttgtgttttagtgttgaagattaaataaagtaatataaaataaatttttaagaatttatagagctttattttaaggattgaaaagaaggttaaggtgtgttttttagcttatttttatatgtttttgtgatttggagatttattttgtagttaaaatgagttttgagatttgtatttttatgttttatttaatgattaggtctattagaagaattgagtttaaataattggggaagataattttttaaaaagagatttttaatttttgtttgttgatttttaaatttgttttattaagataagttttttgtgagaaatttggttgttagattttggaattggttttaatggttaattttataaattgagatgggagattttttttgatgggaggtagtttttatttttaaagtttatgttttagttggaatgtatatgttaaggatttttgttttggtcaatttgggttttatattgtgagtatataaaaagtattatatggttaatggaggatgaggaattatggtaaagtaggtaggtaagttttaagaaataaaataatttgttaaaaaataatttttgatgattattgtaagattgaaagtgtaggaaaaatatagtttgaataattttagatttttttatattttttttttttttatatattttgttattttataataaaatttttaatggaaagtttaaaaataaatagtataggaatatgtgttttaaatgaattaaattgtgaaattagttagtaaattaatttgtagtaagtaattatttaaggaaattaaaatattgtttagtttagttttgtattttattatgtgtatgtgttttttataattaattaatataagtgttttaggaatatttgaagataaatatgtttaatttaaggaataaagtatttaaataatttaagtgtaattttgttgagttaaagtaaaatattttataaatgaagtggttatttaattttttagggaaagtttggttattgaaatgttgtatgtttatgttatattaataaaaatttttaatttattttgtttatgtgttttgtttttttgatattattggtatttgaattttagatggatttttgttaaaatgatattttgtgtgataaaagtatttttagttttgattgatagattaaaataaatgtaaggaaatttttttaaattagattaattttttataaaaatattttagaatgtatgaattttgatatttatatttataatggtaaaagttttttttgtttagtttagtaagataatatttatataaaagagtaaaaaaaaattatattattttatgatagtttgatttttaaattgtttaagaaagtaaagtggttaaattggaaaagaggaatatattttggaggtttagaattgaaaattttttttttaatttttagctggaaaataattttttgtatttatttaaagtgtattttttgaagtgttagattggagttgattggtgattaatttaaaggagttataatttaaagaaatggtgagagcttggtatttaggtctggtttttaggtaatttgtttgggtctgagaggttattaattgttagttaagatggaattttttttttttttttttttttttaatggataataatgggaagggggttaattttttagtagctgaaattttgtatttagttttttattttgagaatgttaatttttggtctgaggatttgtttttgtagtgttggtattgagatttaagggaagatattttgttttaaatgttagttatggtttggttttttttttgattttagtattttgtagattgttagtgtttgtggtgggggatgaaaggaatagggttttgtaaggtttgtttgttgattgtgttattttgggtgaaatttagttttaaaagttataaattatttatggtgaagattttttgaagtggaataaatttttagatttgtattattttatatttttgtgggatagatggtctttatttactggttactgggagagagctgttgtttttgtgttttattgttttctggggtgatttttagtgagttgagtttctggttgtatggtaagtgtttgaaagctgggtctgagaggattgtagggtttttgagggtgttaagttttgaaggagtttatgggtgtattggggtctttgaaatttagttgttattggtagtttttttttgtttttttttagcttttttgtttggttttgtattttttttttttttttttttttttattttttttttttttttttgtttttattttgtgtggggagtgatgtgatgttagtagagattttattaaattttattgtatagtggtgtgtgggtgctggtgagtttgttgtgtggttggtgatttaggagtgagtatagtgtctgggtgagtgctggggggagtgagtaggggtgatgagaaatgaggtaggggagggaagtagatgttagtgggtcgaagagttgggagctggagctgggagagtgaaaggagaggggatttggtggggtatttaggagttaattgaggagtaggagtatggatttttattgtggaaaggaggattagaagggaggatgggatggaagagaagaaaaagtaatttgtgttaatctggtagttttaataaattaaagggggagtgttagggtagtggggagatagaaatgtatttttggggagtaaattaggatgggttgggaggaagtgatagggaaagtggtctaagagatggaataaaggataatgtttatggggttgtttgggatgaggtgtgtggagtgtgggtgtgagtgtgtgtgtgtgatttttttttaggtctgtagagttgaggaaagaggttatagtaaagagggattgtggagggaggaaagtgagagactggtagagggtgggagtggaggtgggtgtggtggggatgggagaggatgagtgaagagaaatttagaagaatggagtgagctagtgggagagggtgggagggtcatagctgggagtgaatgagctaggtttgttagctggggaaggccgggatgttgggtctagcttagctgggatattgtgtttgaggttaaggtgggtggattaggtatgttgagagtgttggtgtataggtgggtatggtcatgtattgatttagtgtttatgaagggtttgtattggataaggtttagatgtttatagagtttagaattttttttgttgtatttatatttaataagtttattttgggttatggatattttattttttaaaatgatgaggttaaggtttttggtgaggatggtattaaattgtatgggatagaagtgggggtgggggagagagttttttttaagtttatatttgtttttgtaaagtaaagagtatgtgaaattatagggtatatttttatttgaaaagtgtgttttatttttgaattttgattttttgattttttgatttgagtaaagatgtgtattttggtagtgagtagaatattttggttttgttttgtttttgagtggaaggattataaatataatttgtttggaggattaggtgtgaaggtttttgttaggtatatgggataatgtttttttaattttaagggtattttgttaatgtatgtttttggaaagtgctggaatatagttattgtttttggatttggatttttttattaatattaatttttgtttgagagtaaaatttaggtctgttattaaaaagatatttttttggtttttaattgagaataaagttttttttaaaagttgtattgttttttttaaattaatatattaatatttgtaattttagaaatatatagtgatttgggagaatgtgtataaaatagatatgtttaaaaaagcttggtgtttaaaattaattttagttattatataggtgttgggttttttttatttttgggggttgtttggaatatgttatgtgtttttttgaattattttgtgttttgaatttatttgagttagtagtaaaaataggtaaataaatttgtttaatttgttttgagtgttaaatttttttattttgaaatagctaatagttgatagatggatttattttatggaaagggttagtttttttagttatgaagaaaattgattagagatttatattttaagttatttttaatttttatgtaatatttgtgaaaatttaaattttttttttttatttagtggaaatttaaagtagtgttatttaaggggagagaaatgagggggaaaatgtttatgtgttgtttaattgtattttttttttgattttgagaatttttatttttggtttttgaaattttgttgaggtaagaaaattaaatttttttaataagttttataattgaattttagttataggatactggaaagtgtagtttgagaaagatatttttatttttgtttattgatgatttttgtagtttttttatttttttgagtaatgggttaataattttttttttttttttttttattttgtagagattaagaggtgtttgtagtagaatggtcttgtttttagctggtggtgaggataggtaatt

SEQ ID NO: 61 - DNA, 9001 bp, Artificial Sequence
  Bisulfite treated of PITX2 B reverse complement after artificially methylated at ggcC, agCt, Ccgg
tgtaaagtgattaggagattaggagaatgttgaaatttttgttggaaaaatgtaaagaaaatttttattttgagttagttgtttatagagttagtgtgtgtgtgtgtgtgtgtgtttgtaatataaaatggatgtgaatatatatatataaatagatatggttttgtttttattttaatttgaattatttagataattgtttttatttattatttgattttaatgggtttatataaattaggatattttatttttttaggtatttaggttgttgttgatttttagtgtttttaatattttgtatatgttggtattatgaggagtagttatgtgtttttgggttttttaattattttggaggttgattgaggttttttatatatgtatatttgttgtgatgaaagttttattggtagagtggagttattagagcttttattaaaattttgtgggtttatgagagatgggtttagaaatttatatggttttgtggggttttttggttttttaaaataaggtattaatatttaagcttttaaaaatatttgtagctttggggtttgaattttgaaaaataaggagtgaggggttgtgtatattaattatagtggagattttttttattttttaatgtgatggagtttttttatgaaatgaagctttaaggggtatggtattgtggggattatagctattttgaggtttaaaagaagaaattggaatatgattagtaaatatatttagtagaaaagagctggatttttattgatttagttataggttattggttggtagtgtaatgggaggaaatatttattttatatatatattttatgattttgggggaattagaggaaatttaataagaaaatggttagaaatatttaaaatttttatttaaaagatttaagtaaattagagttttattagattaaaaattattataaatgtaagagtattgtttttagtgaaatgttgtggggtttgagaaggagattttttgttaaatttctgggataaaatgtgttatttaagtattagataatgagtagaatgtaaattaatttaattttttttattaataggttgttagtgtaatgtgtataatttagtgataagattgtaggatttaatatagctggatgtatgagttttagctaatgtagatttgttatatgaggatgtgttttattttgagtaggtgtttgtatgtgtggaatggggtaaagtggaataaaaggttaaaagtagaaatgttgatttaaagcttattatgaagaaattttttttttgtagctaaattatttttaaagtgggatgatattggtgaagaaagattgaaaaataatttttatgtgtgtttttggattgtaagtttaaaatggggaggagttgtagatagggtttgggggtggttagggtaaaggagagatatataagttgtaaatatatttgtagtttgttttatttattttgttttatattgaataagttttttaattttgtgaataaggataaggagggagtgttttaaagatattttatgttggtattgtaaattattgattgtaatgttaaataaatatatatttagagatgataatattaattttatagtaaaataattgtttatgtagaaatttagaggagattagtttgttttttttagctgatttatgttgggggataaaaggatttttaaaaattattttgaatatgtttggatttttttttttaatttttttggaaattaaatttgtttggaaatagtgttataaagagttgatgtttttaaaggtgattttttttgttttatataaataaggttttgtttttgttagttgagtgtagttttaggttttttgtttttagcttatatatattttttttgtttgtttggattttaatggtttaagatagttttgagcttattgggaaaagaaaatgattgttaaaaattatttttgaaattggttatttggtaatatttttaattgtatggaaatttattaaggtatattttatatataattagcttaaggttgttgattttataggttttatggatttaaatttgattgataataaagtaaataagagagttgaatttaaagtgtggtttttttgggttaggatgagcttaatatagtgtataaggaatttgaaagatttaggatatgtgttttaattaatgttaagtagaatggataagcttttagtattttgaaaatgttgggttagggttttttttttattgtgtgttttttgtttggggattaataagtattatagagaatgtgatttgaggtgattttttatttttgtataaatttagagtgaattattaaatagttgtttgtttaaagttaaggtaatttttttttgatgggtttatttgttttttgatttttaatttattagtttgtttttttagggttttgttttttttgtaattaaagcttttttagattagtgtagtatttatttgataggttgtttggaaaatttaagattggagaggtgatttgttgttgttttttaaattttttagttttaagtaatgtgttttttttttatatggggtgggggattggaaatggatgtagtgagatataaagagtgggtgttttgttgatttttgtatttttttttttttgattattttattttttttttttaagtttttgatttttagttttatttttttatttttgggtttgtattaaaagctggattgttttgggttgggtaggagctgaatttctgggagcttgtttgtgtagatttagtgtgtatggtgaggtagtagtctggtcttgtattgttgataggtgtaggtaggatagtttttttattgtggtttggggtgttttgattggtgtggagttatgttagttgtatctggagaagggtttgggaggaggtggaggtggagagggttggggagggtcgtggtggagtgatgttttggtattaggaagtttgtttttggttttaagatgttaggtcaatagggaagtgtggagttgtagatttggtttgttgtttgtttgggtgtttggagctgagctgtggtaaggtctggtttttgtttgattgtttgaggggtgtgtgtgtgtgtgttgtggagggtgtgtttagagggtcgtgttgtggttgtagtggttgttgttgttgtaggggatttaatattatttatttgtttttgttatttttgatatttttttgttagggttgttgtgtggggggggggtgggtagagtgtggttggtgttagctttttttattggaggggtttttgggggagggagggagagaagaagggggtttttgtttatttttgttttgttttggagcttggaagtttgttttttaaagatgttttgagtggtgtttttttgtttatattttatgtttttgtttgtttgttgattttttgtttctggatttttttgtttgagttttctggaggagatgggggtagcttggtttgagaatttggtgggggttgtgttttttggttttttttgtagtggggaaattttgtgtttagagtgtgatctggagtgggtagtggtggttatgggggtttggtggggtagtagttaaggattagtagagtgttgtgtttttttgtttatgaattgtatgaaaggtctgttttatttggagtattgagtagtggggattaagctgttggtcgtttttttatttttttgttattatttttagttgttagttatggttttggttttggtttctggttagttctggttgttggatttttttaagtataggttggaggtgtatattatttttgatatttttagtctggaggtcgtaggtaaggtgttgtgttgttttgtagatatttttgtttagctgttttgtgttatttgtttttttttgttttaaggaagttagtttttctggggggaggtgtggtgggagtggttgtttgtttggttttttgtagaatttctgggagctggaattttgattattttgtatttttttagtttttttttgactggtctggtttttggggtgttaagggtgtgagtaattttgttgttttttttatttgtattttggtcttttttttgttttttgggttataaaaattttagtattttgatttgaggatttttagaggtcgttgatttttgtttttgttttttttttggtttttagcttttgaggagctttatttgttaggaaattgtttgaaattatttagaaatgttttttgtgaagaggtattttttttttttttttgggaaagggccggtgaattttggtgtttaattgaatttttatatttttttttagtttttttaaattgtatggaaatttgagctttttgtgagggggaggggggtttgtaaattatgtgtgtgtgtgtgttttaggagatttggtgtgtttgtgtagaggtgtataaatatatttgaaagtataggttataaaagtgaatgtgttgttgtagtgagataaatatgtaaataaaatgtgtggtgttgggggaggggaggaaatggggtgtggatatttatatttgtgtttgtatattttataggtgtagtgttttttgtggtctggagttgttgtgtgtatttttttctggtgttaggtagtttagcttttttatggtttttgttgctggtttagttggtgtttgtgttgtaggtgggtatgttgatgggaaagtgtgtgtgttttgtttttagagaaagataaaagttagtaggggaagaatgaggatgtgggtgttgaggatttgtttaagaagaagtggtaaaggtggtagtggatttattttattagttagtagctttaggagctggaggtcattttttagaggaattgttatctggatatgtttatatgtgaagaaattgttgtgtggattaattttatggaagtttgagtctgggtaggagttagtatggagtttgggagggatggggggaggatgttgtggaggtataggtcaagtagattaggagagaatgtggaaggtagtgttgtttgggagggtgctggtggggtgtagctttgtaaaggtagaaggtcttgtggtggtctggttgtgagattatagttttttttttgaggtcgataggattgttgttttggtttaggtttttagagtggtactggtttattgttttgttattttgtgattttatgagctgggttgtatgggtaattttttgtataggatattgtgtttttggtttgtagttgttagagtagagctaataaaatttttattaggtcaagagttgtgaataggttttaatttgtgagtttttaataaggaaaatttgttagagatatggaagagttggtcttttttgggaaatttttgttctggtcttggtctagcttttttttttttgggtttgtgttttttatattttttttatggttgttttggtcatttaggttttttttatatattttattttttagttttgtgatttctgggagtaaagttttaatatataattattagtttttttagaaggagaaagaaaaaaagaagaaagatttttttgtttggtttatttatttttttttaggagttgaattttggaaattgaaatttatatttttttttttaaattataattatagttttgtaaaaagggtttattttaattttgtagtaaatttgtattttatggattggtaaaaatgagcttaaataaataatttaatagtaatgttttggtttatgttggttggtggaagattttaaatttgttaggattttggaagtagaaaatagaattaagtaaattaagtggtatttagaggttttgttgttaaaaaaaaaaaattaagtgttttgggtagaaaaaataaagtttctggttagagtagagtaaataaaaagaagaaaataatgataaaaagaataaagattaaaatgtttttttaaattagagggaatgaagatattttttgggtggtatttgtgtaaggtatgaggttatgttggtggataaaaggccgggaagaagttgaaaatggttttagtttaattgtttagagttagagctgggttttgggtggtgtggttttgagtaaggttagttttttattagcttttttgtatattaagggaatgggtcttttatgtattttttttgtttgagtaaagtttagatggtctagggtagaaatggtaagtaattaaagatagagtttatgggttttttgggattttttgaaaatgtttttttattttgtttgttattttgtagctttattttagtgttttgtagttgtggtgttgggttttttttgtagctgtttttttttttagggtggttgtttgttgagttaagtgggagtgaggtgtgttttttatagtagttgggtgtaaagaggaagggggataaaaaggaaattaagaatgaaaggaaaaagagaaaaagtggattatatggttgggtctggtggagatgtgtaatgtgaaatattattggtgttagcttggatattttaggtcaggtctttttttaatatataaaagttgttgtttggggtgatagggaggtctgatgtggattgggattggggttgtggttgggtcactggatatgggtggaagctggccggtctgggtggtcgtttgtaaagttaaatgatctggttgggtctggtgtgtggataggtctgtggtgggtttagggtaaagaagaggtagagtgaaagaagggggaatttttaaaattattttttctgggtttctggagtttaatatgttaagcttttggagttaatgagctgatgaagaggtggttttttgttttttatttggttgttttgttaggtgagaaagagtgttggtggtctagtttttgttaagggagtatgtattagggggtgggggatgatagtggaggttagggaaggaagggaggaattgtgtgggagaaagagtgattttttagtgtttttttagttttttttttttatttgtgggtttgtggttttggaatggaagtaagtttgtaaggtgttctgggaagggttggaaaagtttgttgttttgtgtttgttttatattaagtgtttttggatttggagaaatgtttggttgagtgattaaattgtttgtaggtttttatgtgtttggttgaggtttgtggtgtagctttgagttttagcttgtaggtcagagtagattaggttttttgtgtttggtggagatctgggtcagtaattgaaagctggtcttggtattttggtgtgtagggtggtgtagtgaagtgaggtcagggtgtgtgagtgtgttagtgtgtgtgttgggggaaggtgggggttggtctttgatggaagttttagtaatttgtattgtggtatttgtttgtttttttgttttaattgtttttaggtttggtttaagaattgttgggtcaaatggagaaagagggagtgtaattagtaggtcgagctatgtaagaatggttttgggtcgtagtttaatgggtttatgtagttttatgatgatatgtatttaggttatttttataataattgggtcgttaagggtcttatatttgtttttttatttattaagagcttttttttttttaattttatgaatgttaattttttgttattatagagtatgttttttttatttaattttattttgtttatgagtatgttgtttagtatggtgtttttagtagtgataggtgttctgggttttagttttaatagtttgaataatttgaataatttgagtagtttgttgttgaattttgtggtgttgatgtttgtttgtttttatgtgttgttgatttttttgtatgtttatagggatatgtgtaatttgagtttggtcagtttgagattgaaagtaaagtagtattttagctttggttatgttagtgtgtagaatctggtctttaatttgagtgtttgttagtatgtagtggactggtctgtgtgagttgtatttatagtgctgggattttaggattttgctggatggggtaattttgtttttgaaagattgggaattatgttagaaggttgtgggtattaaagaaagggagagaaagagaagctatatagagaaaaggaaattattgaattaaagagagagcttttttgattttaaagggatgtttttagtgtttgatattttttattataagtatttttaatagttgtaaggatatatatataaataaatgtttgattggatatgatattttaatattattataagcttgttattttttaagtttagtattgttaatatttaaatgattgaaaggatgtatatatattgaaatgttaaattaattttataaaagtagttgttagtaatattataatagtgtttttaaaggttaggttttaaaataaagtatgttatatagaagtgattaggattttttgtttgtgagtaagggagtgtatatattaaatgttatattgtatgtttttaatatattattattattataaaaaatgtgtgaatattagttttagaatagtttttttggtggatgtaatgatgtttttgaaattgttatgtataatttattttgtgtataatattttgtataatattattgttttattttttagtaaatatgaaataaatgtgttttattttatgggagtaaaatatattgtatataaattggtttggattttttttttttttttttgttattaatttggtcaggatattttagttattgttttttaaataaattagttttttttgtttgtttagttaaatatataaggtagtagtttttatttaaatttggtagaaataaatgatagttatttattagaaattaaaaagaaaaaaaaaggtatttctgggggggaaaagggttataaaatttaattttgtttttttaatttttttttggtttaaatttagaggattttattatggttagtaaataatatgaaaaagaaaaaagaagaaagaaatttagtaagtttattagct

SEQ ID NO: 62 - DNA, 1920 bp, Artificial Sequence
  Bisulfite treated of RASSF2A reverse complement after artificially methylated at ggcC, agCt, Ccgg
tgtagggttggggataggtatgtgagggggagaattttgagtagatagggaatttgtagctgggttgtttaagggtctttgtgtattgggggtgttaggaggtttagggatggaaaagggggaggtgagaaatggataaagaaatttggtctttttggtattgttgttatgtttggccggtctgttaagttgaaggggtctgtttagtttttgtctggtttaaatttttttgggaataagctgggatgttagaaaaaataaaattttataatttttgtttggggaatttaggtcgttggaggtgggtttggtagggtagtgtgattgttttttgggagtggttgttatagctctgggtgaattgaggagcttgggtcaagtttttattttttttggagagggtagtagtaaggaggtgaggggagttagcttattttttttaattttgtattttttttttatttttttatttttagtctggaagaattgttggtggtgggagtttggatgagctggtggggaaggggatgtagttatagtattgtttgggagggaggggagaagctttgtttttagaggggaggggagaagaggagggggtaggagataaggggaggaagaaaggtgaaggtaaggtgaaggggtggagagtgatatgaagagtgagagaaaagagaggatagtggatgagtagatctggtaggggttgaaaaaggtcaaggggttggagggagggagaggaaggaggaggggagtgaggagggtggggtgtctggtttttagttgtgtggtcattgtttgtttagtttggttggatttgagtctggtctgttgattgttggtcgaggtgtagctgaagtagttttttagttgtggtgtttttattttttaattttatggtttttgtggtgtgggtgtgatgtagctggtctggggtgaaggtaaggtgtggggtgtggggtgtggggtattgggagtgaggtattggtgtgggatgtctggtgtaaggtgtagggtgtgggtcgttttttttttgtgtttttttattttgttaaagtttttttatgatggtttttattctggttgggttagttttgtaatttttgtttgttttttgtttttttttttttttttgagttgtggggtttctggggtgtgtggatttttgttaggggtcgtgtaggtgtggagttttagctggtctgttttgggtttgaagaaagttgtggtttggagctagttttttttttatgatttttgggggtgtttttttttttttttgagtttgtgatgggaaggtgtttttattttatttctggggtttttgagattttttggtgaggtggggtggtgtggtaggtgtagggttggggagggtctgatagttttggagagtgtttgattttagtttgttgttgttttttaggtggattttttagaggtaggttttagtttctggtgtggggaggtggtgtgttttagaggggtgtagggtgtgtgggggtcgttggtcttctgggtattttttttttgtggtttttttgtttttttttggagctggtgtttgaggttgttgggattttagtttggtgtttttttttgttttgagtgaggtaggtgttgtgggtggtcctggttatttttgtattttgagtgtttattttgtatttagctttaagttggagagctttggggatagttgagagtgttagtggtcttatagggagattgagggttttgttttattttgggtgttgtgtgggtttgggttgtttatagtatttttgtgttttagtgataggagaagttaagtgtgaggtcttttaatagctgtgtgtattttattttttaggtatttggaattctggtgtttagaatgtgttttttgggagagtaaaggttgtgtttatggtagtttgg

SEQ ID NO: 63 - DNA, 5473 bp, Artificial Sequence
  Bisulfite treated of SHOX2 reverse complement after artificially methylated at ggcC, agCt, Ccgg
ttttattttttgttttattgatgtgttattattgggggggttggagtagtaaaaaaagaagaaggaaaaaaagagtggggttttgttggtagaggttgagtgctgggttgatgtgtggtggtgatggaagaatttatggtgtttgtttttaagttttttgattagaaagtgaaggagaagaaggaggtgattatgtactgggaggtgttggagagtgggtcgttgtgtggggtcaaggagttgactggttgtattgaggtgggtcgtgatgattgtagtagtctggtagtctgggtggccggtggaggtggtggtggaggaggtggaggtggtggtggaggaggtggaggaggtgtaggaggaggaggagtaggtggaggagctggaggagggtgtttttttgtctgggagctggatatgggtgttgttgagagaagtagggagctgggtagtttgtgattgatggagggtaatgatttgattgatttctggtagtggtttttttttttgttttctggattttttttgggtgggagaggattttgaggtctagtggggaggggagagggatatggagagggtcttggattttagctttgttagctagagtgatagtggaagggtgggggtctggtggtatgtttggttatgggtggggttttagtgtgttgtgggggtggtgtggggggaagtgtgtggggtttgtgtgtgttttttttagatgtttttattttattgaaatgtattttttattagtgggaggatgggtctgtagtctggatggtctgtaggtggatgtggaagtttgtggggccgggttgtaggagggggtgttgaattagatggtgggattaaagctagtttttagtgtagagtttgctgggagggagaaggggtagaggtggaaagcttaattttctggttgtttaggtgtttggggtcgttaagattttttgaattttgtagagtttttgaatttttggattttaggggtcaaaattttttatttttttttaaggtagaaggaagttaatgaaagctgaggtttaggttatgttgttttttctgggtgaggtgttttggttttttggtgtgttgggggtggggggggggggtggtgggggaggtggggatttatatttatataatttttttagtgtttttaattatttagtatttggtttttttagagtaaaaattttttggtgttagcttagtgttaggaaatgtttttattttaatggtagagtgttttatattaatttaaaggagtttaataataaaattgatttggtatttggtgtttgtagtaattggtgtattgttatatttttttaattaagaaaatatgtggtatgtgtggaattatatatttaagtaagtaattaagttgtttatgatatggtttgtttttgtttagattagtaattggaaatttggggataaaaatagagattttattaagtttatggattaatttgaaatttggatatttttttgaagttttaaaattttgagtggtatttattgtgtagatgatatgtaatagataaagtttttttattttattggtagaatttgaagggtgtgtttttatatttaaattttaatataatattagtaaaaatattttgttattaaattggtctataatgtttattataatgtttttttttaaagaaaggataaatgtttataaaattaattttgagaattagaaaatatggtaatatttaagattattgtagctagaatgtctggtagggtcgagatttagtgatttttttttttttaaattagtattaggtttttttaaatttgtaaagtggtggagttattgttaaggtgtttagtgtagttttctggtcatgagtttataattataggtctgaattataggtttgttagtgtgtttgatggtgaggtttaggtttgaatttctggtgggtgtagtttttgggattgttgatttttaagcttagggtaagtattaatttttttgtagactggtttttctggaaatgatttttaatatttatgttggtctggattttgtgttgggaagaattgtaaatagttttgattatttaaatttagctttgattttttaaaatctggagtttttgatttgggtgtagaggataaaggttttagggggatatatatatggtggttgtatatgtttatattagaagagcttttgtttttaaagggaggagaaggataggaaagtggtaatggatgtgtgtaaatttagagtagaaaaatttatattttattaaatatttgagctgttggttgtatgaaaaggttttgagtaattaatagaaattgaggattgtgaatattttgtttgaatttgttgatttttgtgggttaagtgtttagggttgagtttgtgtttttatgagggagggtgaagagagaatagaaagagtggttgtttttgtttgttactggaggttggttttttgttttttgttttttggtctggtttgggtggtgagttttttgggtagttaatatggtgtgggtgtttgtgtttgtgtgattctggttgggtaggtgggatggagattatttggttgtttaggggattttatgtagggtttggtctgagtttaggggtagtgaggggtgtttgtggatgtggttttttgtgtggtataatactggggtttgttgtttttgttgatattttttggtctaattgtttttaaattagattagtaagtttgtggtaggtagagagttagtggtggtgagagctggtctgagaatgagttagttttttgggaatggccggtgtgagaggtcagtgggtggtcttgttgtgtttttatgtttagattttgttttgtgagaggtctggtgttgtgtttttgatttttgtgagtgttgtggagtaagtgagtgtgaaagtgagtggaaattatttggtgtttgttggggaaggccggtgattggggggtgaatagtgaggtggtgagttgaggtatgtttgtgaaggaggtggtggatgattgtttattttgttttaggtggtcgtttagatttgatttttgtgtttttctgggatattttttttctgggtgggttgagaagctggattaggattttatgagggggaaggattttttatttttttttgtgataaatttggtaataggatttgttgtgttgtttttgtttgtgtgtgtgtgtgtgtgtgtgtgtgtttgtgtggatgtatgtgtggtcttgttggggtgttttttttagtgtttctggagctgaaagattgtaaagaggatgtgaaagggatggaggatgaaggtcagattaaaattaagtagaggtgaagttggattaattttattttggaataatttaatgagctggagaggttttttgatgagatttattattttgatgtttttatgtgagaggaattgagttagtgattgggtctgttggaggtctgagtgtaggtatttagctgttaggaggttgagggtctagggagtagagagagtttggggttggaaagaggtttgggggatatatttgggaggtggtgtttttagtgtttggtgtaagatgagaaggaaagagatatttttattagaggttttattttttaaagtagattttagttttatagtatttttttttttttttttttttttattttaatatatgtttttagaagaagaaagctgtgttgggtttttttttagagtttttataaattatattttttttgttttgtattggttttaatgtggtttaattttaatgggtctatttttataaggtttaaaaaaaaattttatagaaaatgttttatttttggatgttttaaaagttttaaagagtattttgttttttggagttggatttttttgaaagtttgttttgtagggtttaggtttgttaagtggatattttaattaggtttatagatgtgtagattataaagaaaattagtaattgttaagtgtagaaatttatagtttgttgttagtggttgattttaaattgtgtgtgaaatagtggagaaataaatgtattttggttattttttgtttatttatttaattaaggtaatgaaattgattttaaatatattagattttaaaataaattatatatattagtatttatatttttaaagtttgttttttagtatgtgttatatttaatgaagttaggattgaaatagattttttttattggttgtggaggtaaatgtaatagtaaaaataggttttgggggtatttaaaggagtaaattgtgtatatttatatatatatatttttttagctttagggggaataaatttaaatgttttagattgtatttttgtttagataataaaatagaataaaatgatagttattattggtttgaatatatggagtagttttaggtctgtatatttgtagctgttataaagtattgttgtaatagatatttttttggtttttgggtatagagattattatttgtagtgaattatgtataatttttaaggggtttttttatattttgtaataggattaggaaaaaaaaaaatagagtagttatgttgaagaggaaaagtaataataggttgttttggttattatagtattagtagtagagtttttttttttaagttttttttgttttgttttgtgtattgagatttttagaggtttagtaattttttaaaaatatgatgataattattatagttatgattattagtattttaattttaatttttttaggggaaaaaaaggtaagaagttttaggtcatgtgaattatataaaggatgttattttggtataaaatttattttttgttgtattaaatagtagagaaatttttgaagatttatattgattatgatatttgtttttaaaaatatattaatgaaagctttgaagtagtatttttattttaatggggttttaaaaattttaatttgtgagttaattaatatgttttattattgaaagtggaatataaaagtaagctttatttgaattttaaaaaatttgttatattgtttgtaaaagttgttaagtttaagtaggtaatatttaggagaataaagtatttaagagttatttgttttatatatattttattttttttttgttgagtgttttttttttttttttttaagaagtgaattttattgttgttttatatttttatttatattttagttattttttagatgtttttttattattttaattgtaaatagtggttttttttaaagaagtaaattagattattatgataatggtgtataattattttgttattgtgttttattttgttgtatagtagaatagagaaattttaaatttttttgtagtgaggtttttatgatattaattatttttttttaatttttataattttttttttgtaaaggagttattatttgttttggtgtttggtttttttttaagatgaagctaattaatattat

SEQ ID NO: 64 - DNA, 1405 bp, Artificial Sequence; identical to SEQ ID NO: 1
  artificially CGs methylated, Ca, Ct synthetically methylated

SEQ ID NO: 65 - DNA, 2365 bp, Artificial Sequence; identical to SEQ ID NO: 2
  artificially CGs methylated, Ca, Ct synthetically methylated

SEQ ID NO: 66 - DNA, 4261 bp, Artificial Sequence; identical to SEQ ID NO: 3
  artificially CGs methylated, Ca, Ct synthetically methylated

SEQ ID NO: 67 - DNA, 6343 bp, Artificial Sequence; identical to SEQ ID NO: 4
  artificially CGs methylated, Ca, Ct synthetically methylated

SEQ ID NO: 68 - DNA, 9001 bp, Artificial Sequence; identical to SEQ ID NO: 5
  artificially CGs methylated, Ca, Ct synthetically methylated

SEQ ID NO: 69 - DNA, 1920 bp, Artificial Sequence; identical to SEQ ID NO: 6
  artificially CGs methylated, Ca, Ct synthetically methylated

SEQ ID NO: 70 - DNA, 5473 bp, Artificial Sequence; identical to SEQ ID NO: 7
  artificially CGs methylated, Ca, Ct synthetically methylated

SEQ ID NO: 71 - DNA, 1405 bp, Artificial Sequence; identical to SEQ ID NO: 1
  Artificially CGs methylated, ggcC, agCt, Ccgg synthetically methylated

SEQ ID NO: 72 - DNA, 2365 bp, Artificial Sequence; identical to SEQ ID NO: 2
  Artificially CGs methylated, ggcC, agCt, Ccgg synthetically methylated

SEQ ID NO: 73 - DNA, 4261 bp, Artificial Sequence; identical to SEQ ID NO: 3
  Artificially CGs methylated, ggcC, agCt, Ccgg synthetically methylated

SEQ ID NO: 74 - DNA, 6343 bp, Artificial Sequence; identical to SEQ ID NO: 4
  Artificially CGs methylated, ggcC, agCt, Ccgg synthetically methylated

SEQ ID NO: 75 - DNA, 9001 bp, Artificial Sequence; identical to SEQ ID NO: 5
  Artificially CGs methylated, ggcC, agCt, Ccgg synthetically methylated

SEQ ID NO: 76 - DNA, 1920 bp, Artificial Sequence; identical to SEQ ID NO: 6
  Artificially CGs methylated, ggcC, agCt, Ccgg synthetically methylated

SEQ ID NO: 77 - DNA, 5473 bp, Artificial Sequence; identical to SEQ ID NO: 7
  Artificially CGs methylated, ggcC, agCt, Ccgg synthetically methylated

SEQ ID NO: 78 - DNA, 1405 bp, Artificial Sequence; identical to SEQ ID NO: 22
  artificially, CGs methylated, reverse complement Ca, Ct synthetically methylated

SEQ ID NO: 79 - DNA, 2365 bp, Artificial Sequence; identical to SEQ ID NO: 23
  artificially, CGs methylated, reverse complement Ca, Ct synthetically methylated

SEQ ID NO: 80 - DNA, 4261 bp, Artificial Sequence; identical to SEQ ID NO: 24
  artificially, CGs methylated, reverse complement Ca, Ct synthetically methylated

SEQ ID NO: 81 - DNA, 6343 bp, Artificial Sequence; identical to SEQ ID NO: 25
  artificially, CGs methylated, reverse complement Ca, Ct synthetically methylated

SEQ ID NO: 82 - DNA, 9001 bp, Artificial Sequence; identical to SEQ ID NO: 26
  Artificially, CGs methylated, reverse complement Ca, Ct synthetically methylated

SEQ ID NO: 83 - DNA, 1920 bp, Artificial Sequence; identical to SEQ ID NO: 27
  artificially, CGs methylated, reverse complement Ca, Ct synthetically methylated

SEQ ID NO: 84 - DNA, 5473 bp, Artificial Sequence; identical to SEQ ID NO: 28
  artificially, CGs methylated, reverse complement Ca, Ct synthetically methylated

SEQ ID NO: 85 - DNA, 1405 bp, Artificial Sequence; identical to SEQ ID NO: 22
  Artificially, CGs methylated, reverse complement ggcC, agCt, Ccgg synthetically methylated

SEQ ID NO: 86 - DNA, 2365 bp, Artificial Sequence; identical to SEQ ID NO: 23
  Artificially, CGs methylated, reverse complement ggcC, agCt, Ccgg synthetically methylated

SEQ ID NO: 87 - DNA, 4261 bp, Artificial Sequence; identical to SEQ ID NO: 24
  Artificially, CGs methylated, reverse complement ggcC, agCt, Ccgg synthetically methylated

SEQ ID NO: 88 - DNA, 6343 bp, Artificial Sequence; identical to SEQ ID NO: 25
  Artificially, CGs methylated, reverse complement ggcC, agCt, Ccgg synthetically methylated

SEQ ID NO: 89 - DNA, 9001 bp, Artificial Sequence; identical to SEQ ID NO: 26
  Artificially, CGs methylated, reverse complement ggcC, agCt, Ccgg synthetically methylated

SEQ ID NO: 90 - DNA, 1920 bp, Artificial Sequence; identical to SEQ ID NO: 27
  Artificially, CGs methylated, reverse complement ggcC, agCt, Ccgg synthetically methylated

SEQ ID NO: 91 - DNA, 5473 bp, Artificial Sequence; identical to SEQ ID NO: 28
  Artificially, CGs methylated, reverse complement ggcC, agCt, Ccgg synthetically methylated

SEQ ID NO: 92 - DNA, 1405 bp, Artificial Sequence
  Artificially, CGs methylated, Ca, Ct synthetically methylated, bisulfite treated
cgttattcgagttgtaaagggcggctttctgtgtctgtttcgctgcatcgatacatcgagctgcgcacggtgttcagcgcagggagaacaaatgatcatctgttcaacgcgttcatttacaggtgaggaaactaaggcttcaactcaatcgacgcactctgttcttttgattatcagaaaagtagcaggacaggtgttctgtttcgttctatttcggttcactaagtcggcatttcggcttcgattttcggctgtgttcggcgtcgtcgcggtgttcggcgtcgtcgtctcgttcggcggggtcgttcggagcgttcgcatcttcgttcgctttcatctggtcgggttcgtttcgttcggactcgggactgggaagtgcggcgactttcggaatcagtcattggcgtcagcgcggggagctgggggtgcagagctgcgggcgcggcgggtcacgcaggcggttttcattttcggtctggtctggtctggtctggtctgcgctgtcgcgcgggggcgttttctttcaggttcggcgttcgtcagtttcgcttcgtcaggtgcagcgcagcgcaggggtgggcgggggtggggctcggcgcgcacgttcacggggcggggagggggcgggtcaggggcgggatcacagtcggctgggtcggggttctatgcgcatcttcggggaggggcggggcgggggcggggtcggggcggggttcggtcggtgcacttcagacggcgggtcgttttctcttttcgtctttctactatcggttcaggattagcgttctgggagcgcgcgtttcgctgtctcgtcgtcacacttttctgggagcggcggtcacggaggcatcatgaagaagtcttactcaggtgggcttcgcgttcggggtggggaggggtcggtgtttcgggatcagcgctgctcatctgagtgtctgcggtcgggagtggcgaggcgttttcggagctgagcgagttttcgcggcgggcacactgcaggtcgagtttctttcaggacagggtcgctgtcgggtcgctttcgatctgagtcgatcgttttctgcgctgtcttcagttcttgctcgagtgtcggaggggctgttctgggggacgctttctctttctcgtttcttgcattctcgcaggaatcgctgacttttcaggtcggtcgggtgctttgggtttctgtgcgtctgtgtgggtgaatggggtcggggctaggtggaggggtgttcttgggttcagtctctagggctggtggttcaggtcgcagcattctttcttcggattctcttcggtttcttctctacttagtggggcacgggacggtcttcagatgggatcgttcagcagcgttcaaacttggcgactcgggttcacgttttgcgctcaggacgtcgttcgt

SEQ ID NO: 93 - DNA, 2365 bp, Artificial Sequence
  Artificially, CGs methylated, Ca, Ct synthetically methylated, bisulfite treated
gtggtcgtggtgggggtgttagctgcaggggtgttctcggtgggtgggagttggtggtctctcgctggtgtcatgggactcgcatgttcgttctgcgtttctcggctcttgagttcacaggtcgggattctgtctgtcagtcgcgtgcgctgtcgtttaattcttgcaggcgcagagcgcgcggcggcggtgacagagaactttgtttggctgttcaaatacagtcttctgcagaaggattctgcgttcggggaaggggaggaatctctttttctctgggcgttcgttcttctcgtcatggttcggtcttcacattcgttcacatctggtcgcagcggggcgttcggggggaggggctgaggtcgcgtctctcgtcgttttctgggcgcgggtcaggcggggaggaggggggcgcttcggtcgtgtgttcaggactgtttttcagcggtcactcgggtttcagtttttcaggtctggtcttgacaggcgggcggagcagtcagtgcgagacagggaggtcggtgcgggtgcgggaatctgattcgttcgggaggcgggggcggggcgggggcgcagcgcgcggggaggggtcggcgttcgtctttctttttcattcattcagctgagtcagggggtctaggggcttcttcggcggctagctctgcactgcaggagcgcgggcgcggcgtttcagtcagcgcgcagggttcgggtttcgtcgggggcgctttctcgtcgctgttcttcgcgcgattcgctgttcatcagtcatcatgtcggatttcgcggtcaacgcgcagctggatgggatcatttcggacttcgaaggtgggtgctgggctggctgctgcggtcgcggacgtgctggagaggattctgcgggtgggtctggcgcgggacgggggtgcgctgaggggagacgggagtgcgctgaggggagacgggatttctaattcaggcgttctttcgctgagagcgtcgcgcgttttcggtttcgtgttcgcgtcgtctacgtgggggattctgttaggggcattcgcgtagattctgcgcgttctcacaggattctgtgctcgttctgcgcactgtcgtctgggttttctttcttttattgttgtttgtgtttgtcaagcgacagcgatcttctcgagggctcgcgaggctgtctcggaactcttcaggacgcacagtttcactctgggaaattcatcggttttctttctttggctcttttcggcggctctcgggtttcgcttggattcggcaacgggatagggaggtcgtttctcatcttcgactgagtggacagtcgcgttctgctcgggtggacagttcttttctttttcacgtcagtttcggggtcgtcaagttgtgcagttcgtgggtcgggagcatcgaacggacacagttcaggtcgtggcagggtctagagtgggatgtttcatggttttcattcaggtctggggatattctcattcgtctttcagaatcgggtcgtgggggacagaaggggtctgcgtgcgggcagggagagtattttggctctcttctgtcttcggggtttacaaagtgtgttgggacttgcggggctgctctgttcaagtctgggtctggcgttcgcgtctctgagtctgtgagtgcgtgcgcttttctgcgttctcttgactgtcggtgctggggctctgcgttctgcgttcgcgggagtaaatacagcaggcgaaggggaagctcacacaatggtcttcagcgctctggggcagggcttctgaggggcgggtctgtctctgtcgggatctggagttttcgtttctcggagaggcttctaggctgacttgggcagagttctctggtgggtcgggagggggaaaggctgtgttgaaatgagcaaactgttcaggtgtcaggtcaagctgggaggtgatcagtctgaggttcttttcgcttcatggtcagaatcagggctgacatctgggtgttctgagttcagctgttcacacggttcatctggggtcagttctatctgagtgggggaggcggggtcttctgggggatcagaactttggctggacgtcaagcagagtgtcagtggctgttcttcagggctgggtctgaggagggtgtggggcggcgaagggacgggagggggttgtgattcagtggtcactggcgctgtgcagagtgtgagctggaaacatcgtagttactttgtcagcttagtggtgaaagttctttttcaggctctatttctttgcatttctgcttttcagagggaggggaggtctgggtctgcagagctgggagggcttgctgttttcgtttttctttttcacaacatcttctcatctggacatctttgggcacatgt

SEQ ID NO: 94 - DNA, 4261 bp, Artificial Sequence
  Artificially, CGs methylated, Ca, Ct synthetically methylated, bisulfite treated
aacaagagatcaatatctagaataaatggagatctgcaaatcaacagaaagtaggcagcaaagtcaaagaaaatagtctaaggcacagtcactaaaaggaacgtgatcatgttctttgcagggacatgggtggagctggaagtcgttagtctcagcaaactcacacaggaacagaaaatcagcgagatcgcatggtctcacttataagtgggagctgaacaatgagaacacatggtcacatggcggcgatcaacacacactggtgtctgttgagcggggtgctggggagggagagtatcaggaagaatagctaagggatactgggcttaatatctgggtgatgggatgatctgtacagcaaatcatcatggcgcacacatctatgtaacaaatctgcacattctgcacatgtatttcagaacttcaaataaaagttggacggtcaggcgtggtggctcacgtctgtaatttcagcactttgggaagtcgaggcgtgcagatcatctaaggtcaggagttcgagatcagttcggtcaacatggtgaaatttcgtctctactaaaaatacaaaaatcagtcagatgtggcacgcatctataatttcatctactcgggaggctgaagcagaattgcttgaattcgagaggcggaggttgcagtgagtcgtcgagatcgcgtcactgcacttcagtctgggtcacagcgtgagactacgtcataaaataaaataaaataacacaaaataaaataaaataaaataaaataaaataaaataataaaataaaataaaataaaataaaataaaataaaataaagcaattttcttttctctaagcggtcttcatttctcttttctgttctgtgaagcgggtgtgcaagcttcgggatcgcagcggtcttagggaattttttttcgcgatgtttcggcgcgtcagttcgctgcgcacacttcgctgcggttctctttctgctgtctgtttactttctaggtttcgctggggatctgggaaagagggaaaggctttttcggtcagctgcgcggcgacttcggggacttcagggcgtttctctgcggtcgacgttcggggtgcagcggtcgtcggggctggggtcggcgggagttcgcgggattcttcagaagagcggtcggcgtcgtgactcagcactggggcggagcggggcgggatcattcttataaggctcggaggtcgcgaggtcttcgctggagtttcgtcgtcgcagtcttcgtcatcagtgagtacgcgcggttcgcttttcggggatggggctcagagctttcagcatggggtcaattcgcagcatcaggttcgggctttcggcagggcttctcgttcatctcgagattcgggacgggggtctaggggattcaggacgttttcagtgtcgttagcggctttcagggggttcggagcgtctcggggagggatgggatttcgggggcggggagggggggcaggctgcgctcatcgcgtcttggcattctttttcgggcttcagcaaacttttctttgttcgctgcagtgtcgttctacatcgtggtctatttttcagttcgaggtaggagcatgtgtctggcagggaagggaggcaggggctggggctgcagttcacagtttctcgttcattcggagagattcgaattttcttatttcttcgtcgtgtggcttttatttcgggtcttctttctgtttttcgtctctttcgtcatgtctgcttttcgtttcagtgttgtgtgaaatcttcggaggaatctgtttatctgttttctttctgcacttctgatttcttttcgggttgctgcgaggcggagtcggttcggttttcacatctcgtacttctttcttttcgcaggtcgctgcgcggttctgcgcatgctgctggcagatcagggtcagagctggaaggaggaggtggtgatcgtggagacgtggcaggagggctcactcaaagtcttctgcgtaagtgatcatgttcgggcaaggggagggggtgctgggtcttagggggctgtgactaggatcgggggacgttcaagctcagtgtttctttctgagtcatgtctttttcaacagctatacgggcagcttttcaagtttcaggacggagatctcattctgtatcagttcaatatcattctgcgtcatctgggtcgcattcttggtgagtcttgaatcttcaagttcagggcaggcatgggcaagtctctgttttcggagttcttttgtttaaatcagctgtttcgcagttctctggagtggaggaaactgagattcactgaggttacgtagtttgttcaaggtcaagtctgggtgtctgcaattcttgttctgtgtcaggctgtctttcaggtgtcaggtgagctctgagcatctgctgtgtggcagtctctcattctttcacgcacattctctttttcttctttcaggctggggctcacagacagttttctggttggttcattttcagtgactgtgtgttgatcaggcgttcagtcacgcggtctgcttttcttcattcaatttcagggctctatgggaaggatcagcaggaggcagttctggtggacatggtgaatgacggcgtggaggatcttcgctgcaaatacatctttctcatctacatcaactatgtgagcatctgcatcagggttgggcactgggggctgaacaaagaaaggggcttcttgtgttctcatttttcttatttctcaggtggcttgggctgatttcttcttgggtcagggtgcaggggctgggtcagctctgggtcaggggttcaggggtctgggacaagacacaatctgcattcttattgtctgggacatcaatcagtcaagtaacgggtcatgggggcgagtgcaaggacagagatcttcagcaactggtggtttctgatcttctggggtggcgagggctttctggagtagtcagaggtggaggaggatttgtcgtcagtttctggatggaggtgctggcacttttagctgaggaaaatatgcagacacagagcacatttggggatctgggatcagttcagcagaggcagcgtgtgtgcgcgtgcgtgtgcgtgtgtgtgcgtgtgtgtgtgtacgcttgcatttgtgtcgggtgggtaaggagatagagatgggcgggcagtaggttcaggtttcgaaggtcttgaattcactggtttggagtcttctaagggcaatgggggtcattgagaagtctgaacagggctgtgtctgaatgtgaggtctagaaggattcttcagagaagtcagctctaaagcttttgcaatcatctggtgagagaattcagcaaggatggacaggcagaatggaatagagatgagttggcagctgaagtggacaggatttggtactagtctggttgtggggagcaagcagaggagaatctgggactctggtgtctggtctggggcagacgggggtgtctcaggggctgggagggatgagagtaggatgatacatggtggtgtctggcaggaggcgggcaaggatgactatgtgaaggcactgttcgggcaactgaagtcttttgagattctgctgtttcagaatcagggaggcaagatcttcattgtgggagatcaggtgagcatctggtttcatgctgtttctttctcgtcattctctgctttcagatggacacaggtgtgagtcatttgtttagcaaagcagagcagatctaggggatgggcttaggttctctgttttcaatttcttcagtctgctttcgctggctgagtttctagtttttctgttctgcagatcttcttcgctgactacaatctgctggacttgctgctgattcatgaggttctagtttctggctgtctggatgcgttttttctgctctcagcatatgtggggcgtctcagtgttcggttcaagctcaaggtctttctggtcttttctgagtacgtgaatcttttcatcaatggcaacgggaaacagtgagggttggggggactctgagcgggaggcagagtttgtctttctttcttcaggatcaataaaatttctaagagagctactatgagcactgtgttttctgggacggggcttaggggttctcagtctcgaggtcggtgggagggcagagcagaggactagaaaacagcttcttcagcacagtcagtggctttctggagttctcagtctggctgtgtttactgaatctcacaaactagaagaggaagaaaaaaaaagagagagagaaacaaagagaaata

SEQ ID NO: 95 - DNA, 6343 bp, Artificial Sequence
  Artificially, CGs methylated, Ca, Ct synthetically methylated, bisulfite treated
gattgtctattctcgtcatcagctgaaggcaaggtcgttctgctacgagcgtctcttaatctctacaaaatgaaaagaaaaaaagggaggattattagttcattactcagaggaatggggaggctgcaaaaatcgtcgatgggcagaggtgaagatgtctttctcggactgcacttttcggtgttctgtaactagagttcagttgtgggacttgttgaagaaatttgattttcttgtctcggcgagatttcaaaaatcagaaatagaaattctcagagtcagagaggaaatacaattaaacagcacgtgggcattttttttctcatttctcttttcttaaataacactgctttgagttttcactgggtaaagagagaaagtttgagttttcacggatgttacgtggaggttagaaatggcttaaaatgtagatctctaatcagttttcttcgtggctgaagaggctaattcttttcataaaatgagttcatctgtcgactgttagctatttcaaagtgaagggatttagcactcaaaacaaattgagcaagtttgtttgtctgtttttactgctaactcaaatgaattcaaaacacggagtaattcaagaaaacacataacatgtttcagacagttttcaaaagtagggaaagttcagcatctatatagtgactagggttagttttaagcgtcaagcttttttaaacgtatctattttatgcacattctttcgagtcactatatatttctaaaattgcgagtattggtatattgatttaggaagagcaatacaacttttagagggaactttattctcaattagggatcaaagagatgtctttttaatagcgggtctgagttttgctctcaagcaggaattaatattggtgggaaaattcgaattcaggagcaatggctgtgtttcggcacttttcaaaaacatacattaacaggatgttcttgagattgaaaaaacattgtttcatatgtctggcagaagtcttcacatctggttcttcaggcgaattatatttatagttctttcactcagaggcaggacagagtcaaaatattctgctcactatcaaaatacacatctttgctcaagtcaagaaatcagaaaatcagggttcagaagtaaggcacacttttcgagtgagaatatgttctgtaatttcacatactctttgctttgcaggagcaaatgtggacttgagggaaactctctttttcattttcacttctatttcgtgcaatttaatatcattctcgtcaggaatcttaatctcgtcattttaaaaaatgagatattcgtgattcagggtgaacttgttgaatgtaggtacagcagaggaaattctagactctatgagcgtctgagtcttgttcagtgcaaattcttcgtgaacactgggtcagtgcgtggtcgtgttcatctgtgcgtcgacactctcagcatgtctggttcattcgtcttgatctcgggcgcggtgtttcagctaagctgggttcagcgtttcggtctttttcagctgacaagtctagctcgttcgctttcggctgtggttctttcattctctttcactagctcacttcattcttctagatttctcttcactcattctctttcattttcatcgcgttcatcttcactttcgttctctatcggtctctcacttttctttcttcgcagtttctctttgctgtgatctcttttctcaactctgcaggtctgaaagaaggtcacacacgcacgctcacattcacacttcacacgtctcgtttcaaacaatttcatgaacattgttctttgtttcgtctcttgggtcactttttctgtcgctttctttcagttcgttctgatttgcttttcaaaagtacgtttctgtcttttcgctgttctggcgctttttctttgatttattagggctgtcgggttggcgcagattgctttttcttctctttcatttcattctttcttctggttcttcttttcacagtgggagttcgtgcttctgcttctcggttggcttctaagtgtttcgtcaggttttctcttctttcgctctttcggcttcggctttcgactcttcggttcgctggcatctgcttttcttttctgtctcgtttctcgtcgtttctgctcgcttttttcggcgctcgttcgggcgctgtgctcgcttctggatcgtcagtcgcgcagcgggctcgtcggcgttcgcgcgtcactgtgcagtggagtttggtggaatctctgctgacgtcacgtcacttttcacacggagtaggagcagagggaagagagagggatgagagggagggagaggagagagagtgcgagatcgagcgagaaagctggagaggagcagaaagaaactgtcagtggcggctagatttcggaggtttcagtgcattcgtggacttcttcggaacttggcattctcaggagttctgcagttctctcaggttcggctttcgggcgcttgtcgtgcagtcggaggctcggctcgctggaaatcgtttcgggaagcagtgggacgcggagacagcagctctctttcggtagtcggtaagtggaggtcatctatttcgcagggatgtgagataatgcgagtctggaaatttgtttcacttcggagaatcttcatcgtaggtgatttgtggcttttggggctaagtttcgttcaaggtaacgcagtcggcaaacagatcttgcaaagttctgtttctttcgtttttcgtcacagacactaacaatctacagggtgctgaagtcgagagggaagtcagatcgtggctggcatttaaaacgaggtatcttttcttaaatctcggtgtcaacactgcaggaacaaattctcgggtcaaggattagcattctcaagataaagggctgggtacaaagtttcagctactggaagattagttttcttttcattgttattcattgggaaaaaaaagaaaagaaaaagatttcatcttaactggcagttagtgatctctcaggttcaagcgaattatctgggagtcaggtctggatgtcaagctctcatcatttctttggattgtaacttctttaaattgatcatcagtcaacttcaatctggcacttcaggagatacactttaaatggatgcagagaattatttttcagctggagattaagaaaaaaattttcgattctaaatcttcgaaatatgtttctctttttcagtttaatcactttactttcttaagcaatttagaaatcaaactatcataaggtggtgtgatttttttttactcttttgtgtgagtattgtcttactaaactaaacggaaaaaacttttatcattataaatgtaaatatcagaattcatacattctaaaatatttttatgaaaaattaatctgatttaaagaaattttcttgcatttgttttagtctatcaatcaaaactaaagatgcttttatcacacaaaatatcattttggcagaaattcatctaaaattcaaatatcaataatatcaagaaaacaaagcacataagcaaaataaattgaagatttttgttgatgtaacatgagcatacaacatttcaataatcaaactttttctaaaaaattaaatagtcacttcatttgtggaatgttttactttaactcagcaaaattacacttaaattatttaggtgctttgtttcttaagttaagcgtgtttgtcttcaaatgtttctaaagcacttatattaattggttgtaaagaacgcatacacatggtaaaatacagaactgaactgagcagtattttaattttcttaaataattacttactacaaattaatttactggctaatttcacaatttagttcatttaaaacacatgtttctgtgctgtttatttttaaacttttcattaaagattttgttatggggtaacaaagtgtatgaaaaggggggaaatgtgaaaggatctgggattattcgaactgtattttttctgcactttcagtcttgcggtagtcatcagaaattattttttagcaaattgttttatttcttagggcttgtctgtctgctttgtcatggtttctcgttcttcgttagtcgtgtagtgctttttgtgtgctcacaatataaaattcaagttggtcaaaacaagagttcttggcatatacatttcaactagaacatgaactttgggggtgagaactatctttcatcaggaaaagtctttcatctcaatttgtgagattagtcattgaagtcagtttcgaagtctggcagtcaaatttctcacagaagacttgtcttgatagggcaagtttaaggatcagcaggcgggaattggaggtctctttttaaaaaattatctttttcagttatttagactcagttcttctagtaggtctggtcattaaatgaagcataaaaatgcaagtctcaaggctcattttgactgcaaaataaatcttcaagtcacaaggacatgtaggagtgagctaaggaacacgtcttgatcttcttttcagttcttagagtggagctctatgagttcttgaagatttgttttgtattgctttgtttggtcttcagcactgaagcacggggaagtggggggaagaatgtgtaataattgactgactttacatcaagcaacgcaatctttttcttttgtatatttcattctttaaaaaaaataaataaataaaaactatttgcagttatcatctgcagtgcttcggctatcagctaataatgcagtcagttcagacatataaaaaaaaaagattatcgaaatgatgatgacatgcaaattttcttcgaaattatcataagtaaacatttgaagtctggactaataaaatttcatctgtgttacttcatatcgagttagtagaaagctgtgataatgaattttgtaatatctcacgaacagacatctcaatcagggactaattctgtgattttactgcagaatcactaaatctggagtcgtcaaactgctacttctgggttcacgggttcacaaggatcgaatcggcagagttttcgttcgcgttctcgctagcgggtgggggaatcgtctggtcgttttcattctggattttcacgtcacagcgtcgggcagtttcttctgtaggcagcgatcttggtcagaggcttttcagggttcagctttcttcaggagaggtcgagacgcagggaaacggtactcaggtcagaggcaggttcgcagctttctgtttcgtctctgtgtcttcgtcaattcgacaacgcttgctttcatttcgattttcgcattcgcgcgaagtgggttcttcggtcgtcggcgtattctggttagcgtggagagaggcaggcgctgagatcgaaggggtctagggagttctggatcttcttttcttgtctttaaagcaatcgcggctcttctattcattcggtggagtttctcgagattcatctctttcggcttgtctgtggcagagaagggggagcgcgttaaatgcttggctcgctgcgttgtggttgaaaacgtgaaaaagatttggctcgttcgggagagaaagggggagaactgggtagcagttatatcagagctatttcttcgttcttggcgggcagtaaattcttcaagaacgtttgttctgctcttctcagtctcgctcagttcattcagtgtctcttctctgcgatcttaaatcatactttagggtaattatttgtagtaagtaaataaatggtcgggttagtatctctaggagaaagtgtggctaaatatggaaaagtggcttctgatggatgagaggttcgaactcagctcgcttctgaaacattctaggtcaagagttcgttcgtttcagaattacagaaaatcgagggaaactgctgtctaggacaggggcacgttggcgctgatgttctacaaatgtttatcgagcttcaactaatggacaagcactgaagggtggtctttgcatacagcttttcaaagagaaaagttctcttcattcattcactttcgctgtcattgcgttcagatgagttcttaatttcggcatcgagattcttgaaagtaggttcacagtcttttcagcacactgtggctttatagttctctaatctctgggcacttttgcggcaactctggagggagattttctcttgataaataaatgttctgggttcgaggctaggctggagatgctgctgcacatgtcagaggctgtcaggtcggaaaaacacgtctgaagtctagcacacagtaggcgtctaacagctagtgtaacgtagtctcatctgagttctgctcactcgacggtcgtcgcttcttacagtctttcttctcttctgttttgcaga

SEQ ID NO: 96 - DNA, 9001 bp, Artificial Sequence
  Artificially, CGs methylated, Ca, Ct synthetically methylated, bisulfite treated
agctgatggacttgctaaatttctttcttcttttttctttttcatattatttgctagtcataatggaattctctaggtttaagtcaaagaaaaattggagagacaaaattagattttgtagttcttttttttttcgggaatgtctttttttttctttttagtttctgatgaatggctatcatttatttctatcaaatttaaataaggactgctgtcttgtatgtttaactaggcaggcagagggaactggtttgtttaggaagcagtgactgagatgttctggtcaagttagtgacagaggaggggagaaagaattcagatcaatttgtatgcagtatattttactttcatgaaataaaacacatttgtttcatatttgctgaaaagtaaaacaataatattgtacgaaatgttatacacagggtaggttgtacatagcagtttcagaaacatcattgcattcatcagagaaactattctaaaactgatattcacacattttttataataataataatatgttagaaacatacagtgtggcatttagtatatacactttcttgctcgcaagcgaaaaattctaatcgcttctgtataacatgctttattttaaagtctaatctttaaaaacactgttgtgatattactaacaactgcttttataaaattaatttgacatttcgatatatatacattctttcagtcatttaaatgttaacaatgctaaacttaaaaaataacaagcttatagtaatgttaaaatgtcatattcagtcaaacatttgtttgtgtatgtgttcttgcaactgttagaaatacttgtagtgaaagatgtcagacactgaggacatttctttgaaatcaaaggagctctctctttgattcagtggttttcttttctctatatagcttctctttctctttctttctttagtgttcacgatcttctagcataattttcagtctttcaagggcggagttgtttcattcggcaaggttctaggatttcggcgctgtgggtgcggctcacacgggtcggttcactgcatactggcaagcactcaggttggaggtcgggttctgcacgctggcgtagtcgaagctggagtgctgctttgctttcagtctcaggctggtcaggctcgagttacacgtgtttctataaacatacggaggagtcggcggcgcgtaaggacaggcaggcgtcggcatcgcggaattcagcgacgggctactcaggttgttcaagttattcaggctgttgagactggagttcgggacgtctgtcactgctgagggcatcatgctggacgacatgctcatggacgagatagagttgggtggggaaaacatgctctgtgatgacagggggttgacgttcatagagttgaagaaggggaagctcttggtggatagggaggcggatgtaaggttcttggcggttcagttgttgtaggaatagtctgggtacatgtcgtcgtagggctgcatgagttcattgaactgcggttcgaagtcattcttgcatagctcggtctgctggttgcgctttctctttcttcatttggttcgacgattcttgaatcaaatctgggggcggttggggcaagggagcaaacagatgtcacagtgcagattactaaaactttcatcggaggtcaattttcgtcttttttcgacacacacgctagcgcactcacacattctggtctcgcttcactgcatcgttctgcacatcaagatatcagggtcagctttcagttactggttcgggtcttcatcaagcgcaggagatctggtctgctctggtctgcgagctgggactcggagctacgtcacaaatctcagtcgaacgcatggagatctgcggacggtttgatcactcagtcaggcgtttcttcaggttcaaaaacacttaatgtaaaacaaacgcggggcagcaggctttttcaattcttttcggggcatcttgcaaacttgctttcatttcaaagtcacagattcacggatgaggagaaggggctggaagggcactagaggatcgctctttctttcacgcaatttctttctttcttttctgatcttcactgtcgtttttcattttctggtacgtgctttcttaacagggactaggtcgtcaacactctttctcgtctagcaaaacaatcaaataaagagcaaaagatcatctcttcgtcagctcgttaacttcaggagcttggcatattaaacttcgggaattcggaaagggtagttttggagattttttcttctttcgctctgtctcttctttattctaagttcatcacaggtctgttcgcgcgtcaggttcagtcgggtcgtttggctttgcaggcggtcattcaggtcggtcggctttcattcgtgttcggtggttcagtcgcaatttcgatttcaattcacatcgggtctttctgtcgtttcagacggcggcttttgtgtattggagagaggtctggtctgagatattcgagctgacatcagtgatgtttcacattacacatcttcgtcgggttcagtcgtgtaattcgctttttctcttttttctttcattcttgattttctttttatttttctttctctttgcattcgactgctataaaaagcacgtctcactttcacttggctcgacaagcagtcgttctggaaggagaggcagctgcaaggagagttcagcgtcgcggctacaaagcactagggtggagctgcggaatagcgggcggggtgggagggcgttttcgaaggatttcagaaaattcatagactctgtctttaattacttgtcatttctattctaggtcatctaaactttgctcaggcgagaagagtacgtgagaggttcgttttcttgatgtgcaagagagctaatgaaagactgatcttgctcaaaatcacgtcgttcaggattcagctctggctctggacagttaaactaaaatcattttcaacttcttttcggtcttttattcatcagcatagtctcatgtcttgcacaaatgtcattcagagagtgtcttcattttctctgatttgggagagcattttggtctttattctttttatcgttgttttcttctttttgtttgctctgctctaatcgggggctttattttttctattcagagcacttaattttttttttttaacagcaaagtctctggatgtcgcttgatttgcttgattctgttttctgctttcagaattctaacaaatttggaatctttcatcgatcagcataaatcaggacgttgctattgggttatttatttgagctcatttttgtcaattcataaagtacagatttgctacaaagttaaggtaagttctttttacaaaactatgattataatttagaagagggggtgtgagtttcaattttcagagttcaacttctgagagaagataaataaatcaagcagaaaagtctttcttctttttttctttcttcttctaagaggactagtagttgtgtattaaaactttgctttcggagatcacaaaactaggaaatagggtgtgtgggagagatctgaatggtcgaaacaatcgtaaagaaggtgtaagaagcgcgagttcaggagggaaaaagctgggtcagggtcgggacaaaggtttttcagggagggtcaactctttcgtgtctctggcgggtttttcttgttaaaggctcacaggttggagtctgttcgcggctcttggtctggtagggattttattagctctgctctggcaactgcaagtcaggaacacaatgttctgtgcaggggattgttcatgcagttcagctcgtgagatcgcgggatggcggggcagtgagtcggtgtcgctctgggagtctgagtcagggcggcagttctgtcggtctcggagagggaactgtaatctcgcaatcaggtcgtcgcgaggtcttctgtctttgcaaagctgcgtttcatcggcgttctttcaggcggcgctgtctttcacattctcttctggtctacttggtctgtatcttcacaacattcttttttcatttctttcagacttcgtgctggcttctattcggactcgggctttcgtaaggttggttcacacagcgatttcttcgcgtgtggacatgttcgggtagcggtttctctggaaagtggtcttcagcttctggagctgctggctggtaaagtgagttcgctgtcgtctttgtcgcttcttcttagacgggttctcggcgttcacgttctcattctttttctgctggcttttatctttctctgaaaacgaaacacacacactttttcgtcagcatgttcatctgcaacgcggacgtcaactggatcggcggcagaagtcgtggaagagctgggctgtctggcgtcggaggagggtgcgcgcggcggcttcgggtcgcgaggagcgctgcgtctgtggggtgtgcaggcgcaagtgtgggtgttcgcgtttcattttcttttctttttcagcgtcgcacgttttatttacatgtttatctcactgcagcggcacattcacttttatagtctgtgctttcaagtatatttatacatctctgcgcagacacatcaaatcttctgggacgcgcacacgcgcgtggtttacagatttttctttttctcgcagaaagctcagattttcatgcggtttgggaaggctaggaaaagatgtggggattcggttgggcatcgaagttcgtcggttctttttcaaaaaaaaaaaaaaaatgtctcttcgcgaagggcatttctgagtggtttcaggcaattttctaacgagtggagcttctcgggagctgaaagtcgagaggaaaacagggacagaggtcggcggtctctgaaggttctcgaatcaagatgctgggatttttgtgattcaggaaacagaagggaggtcagggtacgaatagagagggcggcagaattgctcgcgttcttagcgtttcaggagtcgggtcggtcgagggagaactaaagggatgcggggtagtcaaaatttcggctttcggaagttctgcggggagtcaggcgaacgatcactttcatcacgtcttttttcggaggggctgactttcttggggcgagagggagcgggtggcgcagagcagctgagcgggaatgtctgcagggcggcgcggcgtcttatctgcggtcttcgggctggaggtgtcggagatggtgtgcatcttcagtctgtgcttggaggagttcagcgatcggggctgatcgggagtcagaatcgaagtcatggctaacggctggggatggtgacaggaagatgaggagacggtcgacagcttggttttcgctgctcggtgcttcaagtgaagcgggtctttcatgcagttcatggacgagggagcgcgacgctctactagttcttggctactgtttcgtcgagttttcgtagtcgtcgctgttcgcttcgggtcgcgctctaggcgcggagttttttcgctgcggggagagtcaggggacgcaattttcgtcgagttctcaagtcaagctgttttcgtcttcttcggaaggctcaagcgaaaaagttcggagacggaaagtcagcgggcaaacgaagacatgggatgtgggcagaagggcatcactcagagcgtctttagggagcaggctttcaagcttcaaagcgaaacaagagtgggcaaagattttcttcttctctttctttctttttcaagaatttcttcaataaggaaagctaacgtcgatcgcgctctgttcgtttttttttcacgcggcagttctgacagagaagtgtcaagagtgacagggacaggtaggtgatattagattttctgcggcggcagcagtcgctgcagtcacgacgcggttctctgagcgcattcttcgcaacgcgcacacgcacatttctcgggcggtcgaacaggagtcgggtcttgtcgcagctcagcttcaggcattcaggcgagcgacggatcagatctgcggcttcgcgcttttctgttggtctaacatcttaaaatcagaggcgggctttctggtgtcgagacgtcacttcgtcgcggttcttttcagttctcttcgtcttcgtcttctttcagattcttcttcgggtgcgactgacgtggcttcgcatcaatcaggacgtttcgagtcgcggtggagggactgttctgtctgcatctatcagcagtgcggggtcgggctactgtctcgtcgtgcgcactgggtctacacaggcaagctttcgggaattcagcttctgttcagttcaaggcgattcggcttttagtacgaattcaaaggtgaagagatgaggctaggagtcgaaggcttgggagaagagagtggaatggtcaagaagagaaaggtacaaggatcaacaagacattcactctttgtgtctcactacattcattttcaatttttcatttcatataaaaaggagacacgttacttaaaactagaaaatttgaaaaacagcaacaaatcatctcttcgatcttaaatttttcaaacagtctgtcaagtgaatgctgcgctaatctgaagaagctttaattgcaaagaagacagagttctgaaaaggcaggctaataaattagaaatcgagaagcaaatggattcgtcaaaagaaaattatcttgactttaaacgaacaactgtttggtggttcactctggatttatacaagaataaaaagtcgtctcagatcacgttctctgtgatgcttattagttttcagacagaaaacacacaatagaagagaaattctaattcagcgttttcaaaatgctgaaagcttattcattctacttaacgttgattaagacacatattctagatctttcaaatttcttgtacactgtattaagctcgttctaattcgagagagtcacgctttaaattcgactctcttgtttactttattatcaatcagatttaaattcataaagtctgtagaatcaacaatcttgagctaattatatatgaaatatgtcttaatgaattttcatacaattaagaatgttgtcaaataatcaatttcaaggataatttttaacagtcattttcttttttcagtgagctcaaggctgtcttgagtcattaaagttcaagcaggcagaaggggtgtgtgtgagctaagggcgaaaagtctagaactgcgctcaactagcaaaagcaaaatcttatttatataaaacaaaaaaaatcatctttggagacatcaactctttatagcactgttttcaagcaaatttaattttcaaagaaattaaagaaagaaattcaaacatattcaaaataatttttgaaagttcttttgtttttcagcataggtcagctggagaggacaaactaatcttctctgggtttctgcatgggcgattgttttactatggagttagtgttatcatctctgaatgtgtatttgtttgacattacagtcaatgatttgcaatgtcagcatgaagtatctttaaaacactttcttcttgttcttgttcacaagattgggaaacttattcgatgtggaacaaagtggatgaagcagactacaaatatatttgcaacttatgtgtctcttctttgttctgatcattttcaaattctatctgcaacttcttttcattttaaacttgcagttcaaagacgcacatgagaattgtttttcagtctttcttcatcagtatcatttcactttaagaataatttagctgcaagggaggaatttcttcatagtaagctttaaatcagcatttctgcttttaatcttttatttcactttatttcatttcacacatacagacatctgctcagagtaaaacacattctcatgtgacaggtctgcattagctgaggctcatacattcagctatattaggttctgcaatcttatcactaaattatacacattacactagcagtctgttggtaaagaaggttaaattaatttacattctgctcattatctggtgcttaaatgacgcattttatttcggagatttggcggagaatcttcttctcagatttcacagcgtttcactgaagacaatgctcttacatttgtagtggtttttaatctgataagactctaatttgcttaagtcttttaaataagggttttaaatgtttctagtcgttttcttattgaattttctctaattttttcaagatcataaagtatatgtgtaaagtaaatattttctttcattgcactgtcagtcgatgatctataactaagtcaataagaattcagctcttttctgctgaatgtgtttactaatcatatttcagtttcttcttttaaatctcagaatagctgtggttttcacaatatcatgtttcttaaagcttcatttcatgaagggacttcatcacattaaagaatgaaaaaaatcttcactgtagttagtatacacagtttctcacttcttgtttttcaagattcaaatttcagagctgcaaatatttttggaagcttgggtgttaatgtcttattttagaaagtcgagaagtttcacagagtcatatagatttctaaattcatctctcataaattcacagaattttgataaaagctctggtggcttcactctatcgatggaactttcatcacgacaaatatacatgtatgaaggatctcaatcagtcttcaaagtggttgaaaaattcaagggcacgtgactgcttctcatagtgtcaacgtgtgcgagatgttggaagcactggggatcagcagcagtctagatgtctaaaaagataaggtgttctaatttgtgtggattcattgaagtcaagtggtgaataaagacaattatctagataattcagattaaagtaaaagcaaaatcatatctatttgtatatatatattcacattcattttatattacagacacacacacgcacacacacactggctctgtaaacaactgactcaaagtgaggattttctttgcattttttcagcaggagtttcaacattcttctaatcttctaatcactttaca

SEQ ID NO: 97 - DNA, 1920 bp, Artificial Sequence
  Artificially, CGs methylated, Ca, Ct synthetically methylated, bisulfite treated
tcaggctgtcgtagacacagtctttgctctttcgaaaaacacgttctaggcgtcgggatttcagatatctgggaaatagagtgcacgcagctgttgagaggtctcgcgcttggcttcttctatcactgaggcgcagaggtgctgtggacagttcagattcacacggcgttcgaggtgaaacagaattctcagtctttctatgaggtcactggcactctcggctgttttcagagctcttcgacttagagctgaatgcaaagtaagcgctcgaaatgcagaagtagtcggggtcgttcacggcatctgtctcgctcggggcgagagaagacgtcaggctgaggtttcagcgatctcaggcatcagcttcgaaggagggcggggagatcgcaaaggggaagtgttcggagggtcaacggttttcgcgcattctgcgtttctctgaagcgcgtcgtcttttcgcgtcggggactgggatctgtctctggggaattcgtctagaagacggcggcggactggggtcgggcactcttcagggctgtcaggttcttttcagttctgcatctgtcgcgtcgtttcatctcgtcaggaagtctcagagatttcggggatggggtgggagcgtcttttcatcgcgggctcaaaaagaaggaaggacgttttcaggggtcgtagaaggaggactagcttcaagtcacaactttcttcggattcaaggcaggtcggctggggcttcgcgtctacacggtttctggcgggggttcgcgcgtttcgggagtttcgcggctcggggaggaaagaggagacaagagacaggcgaggattacggggctgattcagtcggggtagggatcatcgtggaaaaactttggcgaggtggggggacgcggaaagagagcggttcgcgttctgcatcttgcgtcgggcatttcgcgtcagtgtctcgctttcagtgtttcgcgtttcgcgtttcgcgtcttgtcttcatttcgggtcagctgcatcgcgttcgcgtcgcaggaatcgtggagttggaaagtgggggcgtcgcggctggggggctgcttcagctgcgtctcggtcagcgatcggcgggtcgggctcaaattcagtcaggctgggcaggcggtggtcgcgcgactggggatcgggcgtttcgttcttctcgcttttcttcttctttctctttctttcttcagtttcttggtctttttcagtttctatcggatctgctcgttcgctgttctctcttttctctcgctcttcatatcactcttcatttcttcgtcttgtcttcgtctttctttcttttcttgtcttctgttttcttctcttcttttcttttctctaggggcggagcttcttttctttctttcagacaatgctgtggctgcgttttctttttcgtcagctcgttcaggctttcgtcgtcagcgattctttcgggctgggggtggggaggtggggggggagtgcagggttggggaggatgagctggcttttctcatcttcttgctgctgttctcttcaagagggatggagacttggttcaagcttctcggttcattcggagctgtgacagtcactttcagggaacagtcacgctgttctatcaagttcatcttcagcggtctggatttttcaggcagaggttgtgggattttgttttttctaacatttcagcttattttcaaaagggtttgagtcggacaggggctaaacaggtttcttcgacttggcgggtcggtcagacgtgacagcaatgtcaaggaggtcaagtttctttgttcatttctcatctttttctttttcatttctggatcttctggcgttttcagtacacagaggttcttgagcagttcggctgcaggttttctatctactcagagttctttttctcacgtgtctattttcaattctgca

SEQ ID NO: 98 - DNA, 5473 bp, Artificial Sequence
  Artificially, CGs methylated, Ca, Ct synthetically methylated, bisulfite treated
gtaatgttaattagcttcatcttaaagaaaaatcaaacatcagagcaaataatgacttctttgcggagaaggagttgtaagggttggggagaggtaattagtgtcataaaagtctcactacaaagaagtttagaatttctctgttctgctgtgcagcagagtgaaacacagtagcagaataattgtgcatcattatcatgataatctaatttgcttctttagaaaaagtcactgtttgcagttaggatagtaggaaaacatctagaaaataactaaaatgtaaataaaagtatgaaacaacaataaagttcacttcttaagagaaaaaaagaagagcactcagcgaaaggagaatgaagtatatataaagcaagtaactcttaggtactttgttcttctggatgttatctgcttaaacttgacaacttttacaggcagtatgacagattttttaaaattcaaataaagcttgcttttgtatttcactttcaataataaagcatattgattgactcacaaattaaagtttttaaaatttcattaaagtaaaaatactgcttcagagctttcattggtatgtttttgaaagcaagtgtcatagtcaatgtaaatcttcaaaaatttctctgctatttagtacaacagagggtggattttgtgtcagggtggcattctttgtgtaattcacatggtctgaggcttcttgtcttttttttttctagaagagttggaattaagatactaataatcataactgtaataattatcatcatgtttttaaggggttgctgagtctctggagatctcagtgcacagagcgaagcaggagaggcttaaaaaggaaggctctgctgctgatgctgtgatgatcaaggcagtctattattactttttctcttcaacgtgactgctctgttttttttttttctgattctgttacaagatgtggggaagtttcttaagaattgtgcatagttcgctacagatggtggtctctgtgttcagagatcgaaagagtatctgttacagcgatactttgtaacagctgcagatgtgcgggtctaaaactgcttcatgtgttcaaatcaataataactatcattttattctattttattatctgagcggaaatacaatctgaaacatttaaatttgttttttctaaagctagaaggatatgtgtatgtgaatgtacacaatttgcttctttaaatgttttcaaagtctatttttgctattacatttgtcttcacaatcaataaagaaaatctgtttcagttctaacttcattgggtatggcacgtgctggagggcaggctttggaaatataaatactaatatatgtggtttgttttaaaatctaatgtatttagggtcagtttcgttgtcttggttaaatgaatgaacaaagagtgatcaaaatgcgtttatttcttcgctatttcacacacagtttgagatcgatcgctaacagcagactgtaaatttctgcacttaacagttactaattttctttatagtctgcacatctataaatctaattgggatattcgcttgacaaatctagattctgcagagcagactttcaaggaaattcaacttcagagaacaaaatactctttggaacttttaaggcattcagagataaaacgttttctgtgggatttttttttaagtcttataaaagtaggttcattaggattaaatcacattaaagtcagtgcgaggcaaggggggtgtggtttatagaaactctgggagaaagttcagcacagctttcttcttctgggaacatatgttaggatggaaaaaaaaaaaaggaggggagtgctataggactaagatctactttggaaaataagatctctagtaaagatatctcttttcttctcatcttacatcagacactagaagcatcatctttcgagtgtgtttttcaagtctcttttcaatttcaggctctctctgctttctgggttctcgatcttctggcagctgggtatctgcactcgggtcttcgacaggttcagtcgctggctcagtttctctcgcatgaaggcgtcgggatagtgggtctcgtcaaaaagtctcttcagctcattgagttgtttcagggtgaaattggttcgacttcgtctctgcttgattttggtctggtcttcgttcttcatttctttcgcattctctttgcgatctttcagcttcggggacactggagggggcatttcagcggggtcacacgtgcattcacacgaacacacacacacacgcacacacacacggacgaaaacagcacagcaaattctgttatcagatttgtcgcaaaaaagaatagagaattcttttttctcgtggaattctggttcggcttctcaattcattcggaggaagaatatttcggagaagcgcaaaggtcaagtctgagcggtcgtctggggcaaggtgggcagtcattcatcatcttcttcacaaacgtatctcgactcatcgtctcactattcatttttcagtcatcggtctttttcagcaaacatcaaatggttttcactcactttcgcactcacttgcttcgcagcactcacagaaatcaaaggcgcagcgtcaggtctctcacagagcaaagtctggacataagggcgcggcaaggtcattcactggtctctcacatcggtcattttcagaaggctggctcgttctcaggtcagctctcatcatcgctggctctctgtctatcgcaaacttgctggtctaatttaggaacaattgggtcgaaaggtatcagcgagagcaacagatttcggtgttgtgtcgcacagggagtcgcattcgcagacgtttctcgctgtttctgggctcgggtcaaattctgcataaggttttctggacagtcaggtaatcttcgtttcgtctgttcgatcggggtcgcacgagcacaggcgttcacgtcatgttggctgttcaaagggctcgtcgttcaagtcgggtcagaaggcaggaggcggaaaatcagtcttcggtggcgggcgaaagcaatcgctctttctgttctctcttcgttctttctcgtggaaacgcagactcgattctaaacgcttaattcacagagatcaacaggttcaagcggaatattcgcgattctcggtttctattggttgctcaaagtcttttcatgcaatcagcagctcggatgtttaataaaatatgaatttttctgctctgggtttgcacacattcgttgtcacttttctgttcttcttctttctttaaaaacaggagctcttctagtgtgagcatatacagtcatcatatatatatttttctggaatctttattctctgcgttcgaatcagagacttcgggttttaagaagtcaaagctgagtttagatagtcgaggctgtttgcagttcttttcagcgcaggattcaggtcagcatgggtgttaaaaatcattttcggaagagtcggtctgcagagaaattaatacttgttctgagcttggaaatcaacaatttcaggaactgcgttcgtcgggggttcagatctgaatctcgtcgtcaggcgcgctggcgaatctgtagttcgggtctgtagttgtggactcatggtcgggaggctgcactgggcatcttgacggtaacttcatcactttacaaatttaggaagatctggtgctggtttggaggaagaagagtcgctagatctcggttctgtcgggcattctagctacggtgatcttaaatattgtcgtattttctagttctcagagttagttttgtggacatttgttctttctttaggaaggaacattatagtaaacattatgggtcaatttaatagcaaagtatttttactgatattgtattgaaatttaaatatgaaaacacattcttcaaattctgtcaatgaggtgggaaggctttgtctattacatgtcatctacacagtggatgtcactcaaagttttggggcttcgaggagatgttcaaatttcaagttgattcatagacttaataaaatctctatttttgttttcaaattttcaattactgatctaaacaggaacagatcgtgtcataaacaacttaattgcttgcttaaatatgtgatttcacgcatgtcacatattttcttaattggaaaaatatggcagtacatcagttactgcaggcatcaagtgtcaaatcaattttattgttgaacttctttgaattggtatagaacgctctgtcattgagataaagacgttttctaacactgagctagcatcaaaggatttttgctctaagagaatcgagtactgggtgattgaaaacactaaaggaattgtgtaaatatagattttcatctttttcgtcgtttttttttttcgttttcaacacatcaagaaatcgaaacgtctcgttcgggagaagcagcgtagtctggatctcagctttcgttggctttcttctatcttgaaagagaatgggaagttttggtttctaagattcaaagattcaggggctctgcggagttcgaggggtcttggcggtttcaaacatctaggcgatcggagggttaagcttttcatctctgtttcttctttctttcggcaaactctgcgctagaggctagctttagtttcgtcgtctggttcagcattttcttctgcagttcggtttcgcgaactttcacgttcgtctgcgggtcattcgggctgcgggttcattctttcgctggtgaaaaatgcatttcggtggaatgggaacatctgggaagggcgcgcacaaatttcacacgctttttttcacgtcattttcacaacacactaggatttcattcatgatcgagcatatcatcggattttcattctttcactatcactctagctgacaaagctggggttcagggttctcttcgtgtttctcttttcttttcgctgggtctcggagttctctttcgttcgagaggagttcggaaggcgggaaggggaatcgctgtcgggggtcagtcaggtcgttattcttcgtcagtcgcgggctgttcggctttctgcttctctcggcggcgttcatgttcagctttcggacgggagagcgttcttcttcagcttcttcgtctgcttcttcttcttctacatcttcttcgtcttcttcgtcgtcgtcttcgtcttcttcgtcgtcgtcttcgtcggtcgttcggactgtcgggctgctgcggtcgtcgcggttcgtctcggtgcagtcggtcggcttcttggtttcgcgcagcggttcgctcttcagcatctttcggtacgtgatcgtcttcttcttcttcttcactttctggtcaaaagacttggagacgaacgtcgtaagttctttcatcgtcgtcgcacgtcagttcggcgctcaatctctgtcagcagagtttcgctcttttttttcttcttctttttttactgcttcagttttttcaataataacacatcaatgggacaggaggtgggg

SEQ ID NO: 99 - DNA, 1405 bp, Artificial Sequence
  artificially, CGs methylated, ggcC, agCt, Ccgg synthetically methylated, bisulfite treated
cgttattcgagttgtaaagggcggttttttgtgtttgtttcgttgtatcgatatatcgagctgcgtacggtgtttagcgtagggagaataaatgattatttgtttaacgcgtttatttataggtgaggaaattaaggttttaatttaatcgacgtattttgtttttttgattattagaaaagtagtaggataggtgttttgtttcgttttattccggtctattaagccggtattccggtttcgatttccggttgtgtccggcgtcgtcgcggtgtccggcgtcgtcgtttcgtccggcggggtcgtccggagcgttcgtattttcgttcgtttttatttggccgggtccgtttcgtccggattcgggattgggaagtgcggcgatttccggaattagttattggcgttagcgcggggagctgggggtgtagagctgcgggcgcggcgggtcacgtaggcggtctttatttccggtctggtctggtttggtttggtttgcgttgtcgcgcgggggcgtttttttttaggtccggcgttcgttagtttcgtttcgttaggtgtagcgtagcgtaggggtgggcgggggtggggttcggcgcgtacgtttacggggcggggagggggcgggttaggggcgggattatagccggttgggccggggttttatgcgtatttccggggaggggcggggcgggggcggggccggggcggggtccggtcggtgtattttagacggcgggtcgtttttttttttcgtttttttattaccggtctaggattagcgttttgggagcgcgcgtttcgttgtttcgtcgttatatttttttgggagcggcggtcacggaggtattatgaagaagttttatttaggtgggtttcgcgtccggggtggggaggggtcggtgttccgggattagcgttgtttatttgagtgtttgcggccgggagtggcgaggcgtttccggagctgagcgagttttcgcggcgggtatattgtaggtcgagttttttttaggatagggtcgttgtcgggtcgttttcgatttgagtcgatcgttttttgcgttgtttttagtttttgttcgagtgtcggaggggttgttttgggggacgttttttttttttcgttttttgtattttcgtaggaatcgttgattttttaggtcggccgggtgttttgggtttttgtgcgtttgtgtgggtgaatggggtcggggttaggtggaggggtgtttttgggtttagtttttagggttggtggtttaggtcgtagtatttttttttcggatttttttcggttttttttttatttagtggggtacgggacggtctttagatgggatcgtttagtagcgtttaaatttggcgattcgggtttacgttttgcgtttaggacgtcgttcgt

SEQ ID NO: 100 - DNA, 2365 bp, Artificial Sequence
  artificially, CGs methylated, ggcC, agCt, Ccgg synthetically methylated, bisulfite treated
gtggtcgtggtgggggtgttagctgtaggggtgttttcggtgggtgggagttggtggtctttcgttggtgttatgggattcgtatgttcgttttgcgtttttcggtttttgagtttataggccgggattttgtttgttagtcgcgtgcgttgtcgtttaatttttgtaggcgtagagcgcgcggcggcggtgatagagaattttgtttggttgtttaaatatagttttttgtagaaggattttgcgtccggggaaggggaggaatttttttttttttgggcgttcgtttttttcgttatggtccggtctttatattcgtttatatttggtcgtagcggggcgtccggggggaggggttgaggtcgcgtttttcgtcgttttttgggcgcgggtcaggcggggaggaggggggcgttccggtcgtgtgtttaggattgttttttagcggtcattcgggtcttagttttttaggtctggtcttgataggcgggcggagtagttagtgcgagatagggaggccggtgcgggtgcgggaatttgattcgtccgggaggcgggggcggggcgggggcgtagcgcgcggggaggggccggcgttcgttttttttttttatttatttagctgagttagggggtctaggggtttttccggcggttagctttgtattgtaggagcgcgggcgcggcgttttagttagcgcgtagggtccgggtctcgccgggggcgttttttcgtcgttgtttttcgcgcgattcgttgtttattagttattatgtcggatttcgcggttaacgcgtagctggatgggattatttcggatttcgaaggtgggtgttgggttggttgttgcggtcgcggacgtgttggagaggattttgcgggtgggtctggcgcgggacgggggtgcgttgaggggagacgggagtgcgttgaggggagacgggatttttaatttaggcgttttttcgttgagagcgtcgcgcgtttccggtctcgtgttcgcgtcgtttacgtgggggattttgttaggggtattcgcgtagattttgcgcgtttttataggattttgtgttcgttttgcgtattgtcgtttgggtttttttttttttattgttgtttgtgtttgttaagcgatagcgattttttcgagggttcgcgaggttgtttcggaattttttaggacgtatagttttattttgggaaatttatcggttttttttttttggttttttccggcggttttcgggtctcgtttggatccggtaacgggatagggaggtcgttttttattttcgattgagtggatagtcgcgttttgttcgggtggatagttttttttttttttacgttagtttcggggtcgttaagttgtgtagttcgtgggccgggagtatcgaacggatatagtttaggtcgtggtagggtttagagtgggatgttttatggtctttatttaggtctggggatatttttattcgttttttagaatcgggtcgtgggggatagaaggggtctgcgtgcgggtagggagagtattttggtttttttttgttttcggggtttataaagtgtgttgggatttgcggggttgttttgtttaagtttgggtttggcgttcgcgtttttgagtttgtgagtgcgtgcgtttttttgcgtttttttgattgccggtgttggggttttgcgttttgcgttcgcgggagtaaatatagtaggcgaaggggaagcttatataatggtttttagcgttttggggtagggtttttgaggggcgggtctgtttttgccgggatttggagttttcgtttttcggagaggtttttaggttgatttgggtagagttttttggtgggccgggagggggaaaggttgtgttgaaatgagtaaattgtttaggtgttaggtcaagctgggaggtgattagtttgaggtttttttcgttttatggtcagaattagggttgatatttgggtgttttgagtttagctgtttatacggtctatttggggttagttttatttgagtgggggaggcggggtcttttgggggattagaattttggttggacgttaagtagagtgttagtggttgttttttagggttgggtctgaggagggtgtggggcggcgaagggacgggagggggttgtgatttagtggtcattggcgttgtgtagagtgtgagctggaaatatcgtagttattttgttagcttagtggtgaaagtttttttttaggttttatttttttgtatttttgttttttagagggaggggaggtttgggtttgtagagctgggagggtttgttgttttcgttttttttttttataatatttttttatttggatatttttgggtatatgt

SEQ ID NO: 101 - DNA, 4261 bp, Artificial Sequence
  artificially, CGs methylated, ggcC, agCt, Ccgg synthetically methylated, bisulfite treated
aataagagattaatatttagaataaatggagatttgtaaattaatagaaagtaggtagtaaagttaaagaaaatagtttaaggtatagttattaaaaggaacgtgattatgttttttgtagggatatgggtggagctggaagtcgttagttttagtaaatttatataggaatagaaaattagcgagatcgtatggttttatttataagtgggagctgaataatgagaatatatggttatatggcggcgattaatatatattggtgtttgttgagcggggtgttggggagggagagtattaggaagaatagctaagggatattgggtttaatatttgggtgatgggatgatttgtatagtaaattattatggcgtatatatttatgtaataaatttgtatattttgtatatgtattttagaattttaaataaaagttggacggtcaggcgtggtggtttacgtttgtaattttagtattttgggaagtcgaggcgtgtagattatttaaggttaggagttcgagattagtccggtcaatatggtgaaatttcgtttttattaaaaatataaaaattagttagatgtggtacgtatttataattttatttattcgggaggttgaagtagaattgtttgaattcgagaggcggaggttgtagtgagtcgtcgagatcgcgttattgtattttagtttgggtcatagcgtgagattacgttataaaataaaataaaataatataaaataaaataaaataaaataaaataaaataaaataataaaataaaataaaataaaataaaataaaataaaataaagtaatttttttttttttaagcggtctttattttttttttttgttttgtgaagcgggtgtgtaagctccgggatcgtagcggttttagggaattttttttcgcgatgttccggcgcgttagttcgttgcgtatatttcgttgcggttttttttttgttgtttgtttattttttaggtctcgttggggatttgggaaagagggaaaggtttttccggtcagctgcgcggcgattccggggattttagggcgtttttttgcggtcgacgtccggggtgtagcggtcgccggggttggggccggcgggagttcgcgggattttttagaagagcggccggcgtcgtgatttagtattggggcggagcggggcgggattatttttataaggttcggaggtcgcgaggtcttcgttggagtttcgtcgtcgtagttttcgttattagtgagtacgcgcggtccgttttccggggatggggtttagagcttttagtatggggtcaattcgtagtattaggtccgggtttccggtagggtttttcgtttatttcgagatccgggacgggggtctaggggatttaggacgtttttagtgtcgttagcggtttttagggggtccggagcgtttcggggagggatgggattccgggggcggggagggggggtaggttgcgtttatcgcgttttggtatttttttccgggttttagtaaatttttttttgttcgttgtagtgtcgttttatatcgtggtttattttttagttcgaggtaggagtatgtgtttggtagggaagggaggtaggggttggggttgtagtttatagtttttcgtttatccggagagattcgaatttttttattttttcgtcgtgtggtttttattccgggtcttttttttgtttttcgtttttttcgttatgtttgtttttcgttttagtgttgtgtgaaattttcggaggaatttgtttatttgttttttttttgtatttttgatttttttccgggttgttgcgaggcggagtcggtccggtttttatatttcgtattttttttttttcgtaggtcgttgcgcggtcttgcgtatgttgttggtagattagggtcagagctggaaggaggaggtggtgatcgtggagacgtggtaggagggtttatttaaagttttttgcgtaagtgattatgtccgggtaaggggagggggtgttgggtcttagggggttgtgattaggatcgggggacgtttaagcttagtgtttttttttgagttatgttttttttaatagctatacgggtagctttttaagttttaggacggagattttattttgtattagtttaatattattttgcgttatttgggtcgtatttttggtgagttttgaatttttaagtttagggtaggtatgggtaagtttttgtttccggagtttttttgtttaaattagctgtttcgtagttttttggagtggaggaaattgagatttattgaggttacgtagtttgtttaaggttaagtttgggtgtttgtaatttttgttttgtgttaggttgttttttaggtgttaggtgagctttgagtatttgttgtgtggtagttttttatttttttacgtatattttttttttttttttttaggttggggtttatagatagttttttggttggtctatttttagtgattgtgtgttgattaggcgtttagttacgcggtctgtttttttttatttaattttagggttttatgggaaggattagtaggaggtagttttggtggatatggtgaatgacggcgtggaggattttcgttgtaaatatattttttttatttatattaattatgtgagtatttgtattagggttgggtattgggggttgaataaagaaaggggttttttgtgtttttattttttttattttttaggtggtttgggttgatttttttttgggttagggtgtaggggttgggttagctttgggtcaggggtctaggggtctgggataagatataatttgtatttttattgtttgggatattaattagttaagtaacgggttatgggggcgagtgtaaggatagagatttttagtaattggtggtttttgattttttggggtggcgagggttttttggagtagttagaggtggaggaggatttgtcgttagtttttggatggaggtgttggtatttttagctgaggaaaatatgtagatatagagtatatttggggatttgggattagtttagtagaggtagcgtgtgtgcgcgtgcgtgtgcgtgtgtgtgcgtgtgtgtgtgtacgtttgtatttgtgtcgggtgggtaaggagatagagatgggcgggtagtaggtctaggtttcgaaggtcttgaatttattggtttggagttttttaagggtaatgggggtcattgagaagtttgaatagggttgtgtttgaatgtgaggtttagaaggattttttagagaagttagctttaaagcttttgtaattatttggtgagagaatttagtaaggatggataggtagaatggaatagagatgagttggtagctgaagtggataggatttggtattagtttggttgtggggagtaagtagaggagaatttgggattttggtgtttggtctggggtagacgggggtgttttaggggttgggagggatgagagtaggatgatatatggtggtgtttggtaggaggcgggtaaggatgattatgtgaaggtattgtccgggtaattgaagttttttgagattttgttgttttagaattagggaggtaagatttttattgtgggagattaggtgagtatttggtcttatgttgtttttttttcgttattttttgtttttagatggatataggtgtgagttatttgtttagtaaagtagagtagatttaggggatgggtttaggtcttttgtttttaatttttttagtttgttttcgttggttgagtttttagtttttttgttttgtagatttttttcgttgattataatttgttggatttgttgttgatttatgaggttttagtttttggttgtttggatgcgttttttttgtttttagtatatgtggggcgttttagtgtccggtctaagcttaaggtctttttggtcttttttgagtacgtgaatttttttattaatggtaacgggaaatagtgagggttggggggattttgagcgggaggtagagtttgtttttttttttttaggattaataaaatttttaagagagctattatgagtattgtgttttttgggacggggtttaggggtttttagtttcgaggtcggtgggagggtagagtagaggattagaaaatagcttttttagtatagttagtggttttttggagtttttagtttggttgtgtttattgaattttataaattagaagaggaagaaaaaaaaagagagagagaaataaagagaaata

SEQ ID NO: 102 - DNA, 6343 bp, Artificial Sequence
  artificially, CGs methylated, ggcC, agCt, Ccgg synthetically methylated, bisulfite treated
gattgtttattttcgttattagctgaaggtaaggtcgttttgttacgagcgttttttaatttttataaaatgaaaagaaaaaaagggaggattattagtttattatttagaggaatggggaggttgtaaaaatcgtcgatgggtagaggtgaagatgtttttttcggattgtattttccggtgttttgtaattagagtttagttgtgggatttgttgaagaaatttgatttttttgtttcggcgagattttaaaaattagaaatagaaatttttagagttagagaggaaatataattaaatagtacgtgggtatttttttttttatttttttttttttaaataatattgttttgagtttttattgggtaaagagagaaagtttgagtttttacggatgttacgtggaggttagaaatggtttaaaatgtagatttttaattagtttttttcgtggttgaagaggttaattttttttataaaatgagtttatttgtcgattgttagctattttaaagtgaagggatttagtatttaaaataaattgagtaagtttgtttgtttgtttttattgttaatttaaatgaatttaaaatacggagtaatttaagaaaatatataatatgttttagatagtttttaaaagtagggaaagtttagtatttatatagtgattagggttagttttaagcgttaagcttttttaaacgtatttattttatgtatattttttcgagttattatatatttttaaaattgcgagtattggtatattgatttaggaagagtaatataatttttagagggaattttatttttaattagggattaaagagatgtttttttaatagcgggtctgagttttgtttttaagtaggaattaatattggtgggaaaattcgaatttaggagtaatggttgtgttccggtattttttaaaaatatatattaataggatgtttttgagattgaaaaaatattgttttatatgtttggtagaagtttttatatttggttttttaggcgaattatatttatagtttttttatttagaggtaggatagagttaaaatattttgtttattattaaaatatatatttttgtttaagttaagaaattagaaaattagggtttagaagtaaggtatatttttcgagtgagaatatgttttgtaattttatatattttttgttttgtaggagtaaatgtggatttgagggaaatttttttttttatttttatttttatttcgtgtaatttaatattattttcgttaggaattttaatttcgttattttaaaaaatgagatattcgtgatttagggtgaatttgttgaatgtaggtatagtagaggaaattttagattttatgagcgtttgagttttgtttagtgtaaatttttcgtgaatattgggttagtgcgtggtcgtgtttatttgtgcgtcgatatttttagtatgtttggtttattcgttttgatttcgggcgcggtgttttagctaagctgggtctagcgttccggtcttttttagctgataagtttagctcgttcgtttccggttgtggtctttttatttttttttattagcttattttatttttttagatttttttttatttatttttttttatttttatcgcgtttatttttattttcgttttttaccggttttttattttttttttttcgtagtttttttttgttgtgatttttttttttaattttgtaggtctgaaagaaggttatatacgtacgtttatatttatattttatacgtttcgttttaaataattttatgaatattgttttttgtttcgttttttgggtcattttttttgtcgtttttttttagttcgttttgatttgttttttaaaagtacgtttttgttttttcgttgttttggcgttttttttttgatttattagggttgccgggttggcgtagattgttttttttttttttttattttatttttttttttggtttttttttttatagtgggagttcgtgtttttgtttttcggttggtttttaagtgtttcgttaggtttttttttttttcgtttttccggttccggttttcgatttttcggtccgttggtatttgttttttttttttgtttcgtttttcgtcgtttttgttcgttttttccggcgttcgtccgggcgttgtgttcgtttttggatcgttagtcgcgtagcgggttcgccggcgttcgcgcgttattgtgtagtggagtttggtggaatttttgttgacgttacgttattttttatacggagtaggagtagagggaagagagagggatgagagggagggagaggagagagagtgcgagatcgagcgagaaagctggagaggagtagaaagaaattgttagtggcggttagatttcggaggtcttagtgtattcgtggattttttcggaatttggtatttttaggagttttgtagtttttttaggtccggttttcgggcgtttgtcgtgtagccggaggttcggttcgttggaaatcgttccgggaagtagtgggacgcggagatagtagcttttttccggtagccggtaagtggaggtcatttatttcgtagggatgtgagataatgcgagtttggaaatttgttttatttcggagaatttttatcgtaggtgatttgtggtttttggggttaagtttcgtttaaggtaacgtagtcggtaaatagattttgtaaagttttgtttttttcgtttttcgttatagatattaataatttatagggtgttgaagtcgagagggaagttagatcgtggttggtatttaaaacgaggtatttttttttaaatttcggtgttaatattgtaggaataaattttcgggtcaaggattagtatttttaagataaagggttgggtataaagttttagctattggaagattagttttttttttattgttatttattgggaaaaaaaagaaaagaaaaagattttattttaattggtagttagtgattttttaggtctaagcgaattatttgggagttaggtctggatgttaagcttttattatttttttggattgtaatttttttaaattgattattagttaattttaatttggtattttaggagatatattttaaatggatgtagagaattattttttagctggagattaagaaaaaaattttcgattttaaattttcgaaatatgttttttttttttagtttaattattttatttttttaagtaatttagaaattaaattattataaggtggtgtgatttttttttatttttttgtgtgagtattgttttattaaattaaacggaaaaaatttttattattataaatgtaaatattagaatttatatattttaaaatatttttatgaaaaattaatttgatttaaagaaatttttttgtatttgttttagtttattaattaaaattaaagatgtttttattatataaaatattattttggtagaaatttatttaaaatttaaatattaataatattaagaaaataaagtatataagtaaaataaattgaagatttttgttgatgtaatatgagtatataatattttaataattaaattttttttaaaaaattaaatagttattttatttgtggaatgttttattttaatttagtaaaattatatttaaattatttaggtgttttgttttttaagttaagcgtgtttgtttttaaatgtttttaaagtatttatattaattggttgtaaagaacgtatatatatggtaaaatatagaattgaattgagtagtattttaatttttttaaataattatttattataaattaatttattggttaattttataatttagtttatttaaaatatatgtttttgtgttgtttatttttaaattttttattaaagattttgttatggggtaataaagtgtatgaaaaggggggaaatgtgaaaggatttgggattattcgaattgtattttttttgtatttttagttttgcggtagttattagaaattattttttagtaaattgttttattttttagggtttgtttgtttgttttgttatggtttttcgtttttcgttagtcgtgtagtgttttttgtgtgtttataatataaaatttaagttggtcaaaataagagtttttggtatatatattttaattagaatatgaattttgggggtgagaattattttttattaggaaaagttttttattttaatttgtgagattagttattgaagttagtttcgaagtttggtagttaaattttttatagaagatttgttttgatagggtaagtttaaggattagtaggcgggaattggaggtttttttttaaaaaattattttttttagttatttagatttagtttttttagtaggtctggttattaaatgaagtataaaaatgtaagttttaaggtttattttgattgtaaaataaatttttaagttataaggatatgtaggagtgagctaaggaatacgttttgattttttttttagtttttagagtggagctttatgagtttttgaagatttgttttgtattgttttgtttggtttttagtattgaagtacggggaagtggggggaagaatgtgtaataattgattgattttatattaagtaacgtaattttttttttttgtatattttattttttaaaaaaaataaataaataaaaattatttgtagttattatttgtagtgttccggttattagctaataatgtagttagtttagatatataaaaaaaaaagattatcgaaatgatgatgatatgtaaatttttttcgaaattattataagtaaatatttgaagtttggattaataaaattttatttgtgttattttatatcgagttagtagaaagctgtgataatgaattttgtaatattttacgaatagatattttaattagggattaattttgtgattttattgtagaattattaaatttggagtcgttaaattgttatttttgggtctacgggtctataaggatcgaatcggtagagttttcgttcgcgttttcgttagcgggtgggggaatcgtttggtcgtttttattttggatttttacgttatagcgccgggtagttttttttgtaggtagcgattttggtcagaggttttttagggtctagctttttttaggagaggtcgagacgtagggaaacggtatttaggtcagaggtaggtccgtagctttttgtttcgtttttgtgttttcgttaattcgataacgtttgtttttatttcgattttcgtattcgcgcgaagtgggtcttccggtcgtcggcgtattttggttagcgtggagagaggtaggcgttgagatcgaaggggtctagggagttttggattttttttttttgtttttaaagtaatcgcggtttttttatttatccggtggagtttttcgagatttattttttccggtttgtttgtggtagagaagggggagcgcgttaaatgtttggttcgttgcgttgtggttgaaaacgtgaaaaagatttggttcgtccgggagagaaagggggagaattgggtagtagttatattagagctattttttcgtttttggcgggtagtaaattttttaagaacgtttgttttgttttttttagtttcgtttagtttatttagtgttttttttttgcgattttaaattatattttagggtaattatttgtagtaagtaaataaatggccgggttagtatttttaggagaaagtgtggttaaatatggaaaagtggtttttgatggatgagaggtccgaatttagctcgtttttgaaatattttaggtcaagagttcgttcgttttagaattatagaaaatcgagggaaattgttgtttaggataggggtacgttggcgttgatgttttataaatgtttatcgagctttaattaatggataagtattgaagggtggtttttgtatatagctttttaaagagaaaagttttttttatttatttattttcgttgttattgcgtttagatgagtttttaattccggtatcgagatttttgaaagtaggtttatagtttttttagtatattgtggttttatagttttttaatttttgggtatttttgcggtaattttggagggagatttttttttgataaataaatgttttgggtccgaggttaggttggagatgttgttgtatatgttagaggttgttaggtcggaaaaatacgtttgaagtttagtatatagtaggcgtttaatagctagtgtaacgtagttttatttgagttttgtttattcgacggtcgtcgttttttatagtttttttttttttttgttttgtaga

SEQ ID NO: 103 - DNA, 9001 bp, Artificial Sequence
  artificially, CGs methylated, ggcC, agCt, Ccgg synthetically methylated, bisulfite treated
agctgatggatttgttaaattttttttttttttttttttttttatattatttgttagttataatggaattttttaggtttaagttaaagaaaaattggagagataaaattagattttgtagttttttttttttccgggaatgtttttttttttttttttagtttttgatgaatggttattatttatttttattaaatttaaataaggattgttgttttgtatgtttaattaggtaggtagagggaattggtttgtttaggaagtagtgattgagatgttttggtcaagttagtgatagaggaggggagaaagaatttagattaatttgtatgtagtatattttatttttatgaaataaaatatatttgttttatatttgttgaaaagtaaaataataatattgtacgaaatgttatatatagggtaggttgtatatagtagttttagaaatattattgtatttattagagaaattattttaaaattgatatttatatattttttataataataataatatgttagaaatatatagtgtggtatttagtatatatatttttttgttcgtaagcgaaaaattttaatcgtttttgtataatatgttttattttaaagtttaatttttaaaaatattgttgtgatattattaataattgtttttataaaattaatttgatatttcgatatatatatatttttttagttatttaaatgttaataatgttaaatttaaaaaataataagcttatagtaatgttaaaatgttatatttagttaaatatttgtttgtgtatgtgtttttgtaattgttagaaatatttgtagtgaaagatgttagatattgaggatatttttttgaaattaaaggagctttttttttgatttagtggtttttttttttttatatagcttttttttttttttttttttttagtgtttacgattttttagtataatttttagttttttaagggcggagttgttttatccggtaaggttttaggattccggcgttgtgggtgcggtttatacgggccggtttattgtatattggtaagtatttaggttggaggccgggttttgtacgttggcgtagtcgaagctggagtgttgttttgtttttagttttaggttggtcaggttcgagttatacgtgtttttataaatatacggaggagtcggcggcgcgtaaggataggtaggcgtcggtatcgcggaatttagcgacgggttatttaggttgtttaagttatttaggttgttgagattggagtccgggacgtttgttattgttgagggtattatgttggacgatatgtttatggacgagatagagttgggtggggaaaatatgttttgtgatgatagggggttgacgtttatagagttgaagaaggggaagcttttggtggatagggaggcggatgtaaggtctttggcggtctagttgttgtaggaatagtttgggtatatgtcgtcgtagggttgtatgagtttattgaattgcggtccgaagttatttttgtatagctcggtctgttggttgcgttttttttttttttatttggtccgacgatttttgaattaaatttgggggcggttggggtaagggagtaaatagatgttatagtgtagattattaaaatttttatcggaggtcaattttcgttttttttcgatatatacgttagcgtatttatatattttggtctcgttttattgtatcgttttgtatattaagatattagggtcagcttttagttattggtccgggtttttattaagcgtaggagatttggtttgttttggtctgcgagctgggattcggagctacgttataaattttagtcgaacgtatggagatttgcggacggtttgattatttagttaggcgtttttttaggtttaaaaatatttaatgtaaaataaacgcggggtagtaggtttttttaattttttccggggtattttgtaaatttgtttttattttaaagttatagatttacggatgaggagaaggggttggaagggtattagaggatcgtttttttttttacgtaattttttttttttttttttgatttttattgtcgttttttattttttggtacgtgtttttttaatagggattaggtcgttaatattttttttcgtttagtaaaataattaaataaagagtaaaagattattttttcgttagctcgttaattttaggagcttggtatattaaattccgggaatccggaaagggtagttttggagatttttttttttttcgttttgttttttttttattttaagtttattataggtctgttcgcgcgttaggtctagccgggtcgtttggttttgtaggcggtcatttaggccggccggtttttattcgtgtccggtggtctagtcgtaatttcgattttaatttatatcgggtctttttgtcgttttagacggcggtttttgtgtattggagagaggtctggtctgagatattcgagctgatattagtgatgttttatattatatattttcgccgggtctagtcgtgtaattcgttttttttttttttttttttatttttgattttttttttatttttttttttttttgtattcgattgttataaaaagtacgttttatttttatttggttcgataagtagtcgttttggaaggagaggtagctgtaaggagagtttagcgtcgcggttataaagtattagggtggagctgcggaatagcgggcggggtgggagggcgttttcgaaggattttagaaaatttatagattttgtttttaattatttgttatttttattttaggtcatttaaattttgtttaggcgagaagagtacgtgagaggtccgtttttttgatgtgtaagagagctaatgaaagattgattttgtttaaaattacgtcgtttaggatttagctttggttttggatagttaaattaaaattatttttaatttttttccggtcttttatttattagtatagttttatgttttgtataaatgttatttagagagtgtttttattttttttgatttgggagagtattttggtttttattttttttatcgttgtttttttttttttgtttgttttgttttaaccgggggttttattttttttatttagagtatttaattttttttttttaatagtaaagtttttggatgtcgtttgatttgtttgattttgttttttgtttttagaattttaataaatttggaattttttatcgattagtataaattaggacgttgttattgggttatttatttgagcttatttttgttaatttataaagtatagatttgttataaagttaaggtaagttttttttataaaattatgattataatttagaagagggggtgtgagttttaatttttagagtttaatttttgagagaagataaataaattaagtagaaaagttttttttttttttttttttttttttttaagaggattagtagttgtgtattaaaattttgtttccggagattataaaattaggaaatagggtgtgtgggagagatttgaatggtcgaaataatcgtaaagaaggtgtaagaagcgcgagtttaggagggaaaaagctgggtcagggccgggataaaggttttttagggagggtcaattttttcgtgtttttggcgggttttttttgttaaaggtttataggttggagtttgttcgcggtttttggtctggtagggattttattagctttgttttggtaattgtaagttaggaatataatgttttgtgtaggggattgtttatgtagtttagctcgtgagatcgcgggatggcggggtagtgagccggtgtcgttttgggagtttgagttagggcggtagttttgtcggtctcggagagggaattgtaatttcgtaattaggtcgtcgcgaggtcttttgtttttgtaaagctgcgttttaccggcgtttttttaggcggcgttgttttttatatttttttttggtttatttggtctgtatttttataatattttttttttattttttttagatttcgtgttggtttttatccggattcgggttttcgtaaggttggtttatatagcgattttttcgcgtgtggatatgtccgggtagcggtttttttggaaagtggtctttagcttttggagctgttggttggtaaagtgagttcgttgtcgtttttgtcgtttttttttagacgggttttcggcgtttacgtttttattttttttttgttggtttttatttttttttgaaaacgaaatatatatattttttcgttagtatgtttatttgtaacgcggacgttaattggaccggcggtagaagtcgtggaagagctgggttgtttggcgccggaggagggtgcgcgcggcggttccgggtcgcgaggagcgttgcgtttgtggggtgtgtaggcgtaagtgtgggtgttcgcgttttattttttttttttttttagcgtcgtacgttttatttatatgtttattttattgtagcggtatatttatttttatagtttgtgtttttaagtatatttatatatttttgcgtagatatattaaattttttgggacgcgtatacgcgcgtggtttatagatttttttttttttcgtagaaagcttagatttttatgcggtttgggaaggttaggaaaagatgtggggattcggttgggtatcgaagttcgccggtctttttttaaaaaaaaaaaaaaaatgttttttcgcgaagggtatttttgagtggttttaggtaattttttaacgagtggagcttttcgggagctgaaagtcgagaggaaaatagggatagaggtcggcggtctttgaaggttttcgaattaagatgttgggatttttgtgatttaggaaatagaagggaggtcagggtacgaatagagagggcggtagaattgttcgcgtttttagcgttttaggagccgggccggtcgagggagaattaaagggatgcggggtagttaaaattccggtttccggaagttttgcggggagttaggcgaacgattatttttattacgtttttttccggaggggttgatttttttggggcgagagggagcgggtggcgtagagtagctgagcgggaatgtttgtagggcggcgcggcgttttatttgcggtctccgggttggaggtgtcggagatggtgtgtatttttagtttgtgtttggaggagtttagcgaccggggttgaccgggagttagaatcgaagttatggttaacggttggggatggtgataggaagatgaggagacggtcgatagcttggttttcgttgttcggtgttttaagtgaagcgggtcttttatgtagtttatggacgagggagcgcgacgttttattagtttttggttattgtttcgtcgagttttcgtagtcgtcgttgttcgttccgggtcgcgttttaggcgcggagttttttcgttgcggggagagttaggggacgtaattttcgtcgagtttttaagttaagctgttttcgttttttccggaaggtttaagcgaaaaagtccggagacggaaagttagcgggtaaacgaagatatgggatgtgggtagaagggtattatttagagcgtttttagggagtaggtttttaagctttaaagcgaaataagagtgggtaaagatttttttttttttttttttttttttttaagaatttttttaataaggaaagctaacgtcgatcgcgttttgttcgttttttttttacgcggtagttttgatagagaagtgttaagagtgatagggataggtaggtgatattagattttttgcggcggtagtagtcgttgtagttacgacgcggtcttttgagcgtatttttcgtaacgcgtatacgtatatttttcgggcggtcgaataggagccgggtcttgtcgtagcttagctttaggtatttaggcgagcgacggattagatttgcggtttcgcgtttttttgttggtctaatattttaaaattagaggcgggttttttggtgtcgagacgttatttcgtcgcggtcttttttagtttttttcgttttcgtttttttttagatttttttccgggtgcgattgacgtggtttcgtattaattaggacgtttcgagtcgcggtggagggattgttttgtttgtatttattagtagtgcggggccgggttattgtttcgtcgtgcgtattgggtttatataggtaagcttccgggaatttagcttttgtttagtttaaggcgatccggtttttagtacgaatttaaaggtgaagagatgaggttaggagtcgaaggtttgggagaagagagtggaatggttaagaagagaaaggtataaggattaataagatatttattttttgtgttttattatatttatttttaattttttattttatataaaaaggagatacgttatttaaaattagaaaatttgaaaaatagtaataaattattttttcgattttaaattttttaaatagtttgttaagtgaatgttgcgttaatttgaagaagctttaattgtaaagaagatagagttttgaaaaggtaggttaataaattagaaatcgagaagtaaatggattcgttaaaagaaaattattttgattttaaacgaataattgtttggtggtttattttggatttatataagaataaaaagtcgttttagattacgttttttgtgatgtttattagtttttagatagaaaatatataatagaagagaaattttaatttagcgtttttaaaatgttgaaagcttatttattttatttaacgttgattaagatatatattttagattttttaaattttttgtatattgtattaagctcgttttaattcgagagagttacgttttaaattcgatttttttgtttattttattattaattagatttaaatttataaagtttgtagaattaataattttgagctaattatatatgaaatatgttttaatgaatttttatataattaagaatgttgttaaataattaattttaaggataatttttaatagttattttttttttttagtgagcttaaggttgttttgagttattaaagtttaagtaggtagaaggggtgtgtgtgagctaagggcgaaaagtttagaattgcgtttaattagtaaaagtaaaattttatttatataaaataaaaaaaattatttttggagatattaattttttatagtattgtttttaagtaaatttaatttttaaagaaattaaagaaagaaatttaaatatatttaaaataatttttgaaagtttttttgttttttagtataggttagctggagaggataaattaattttttttgggtttttgtatgggcgattgttttattatggagttagtgttattatttttgaatgtgtatttgtttgatattatagttaatgatttgtaatgttagtatgaagtatttttaaaatattttttttttgtttttgtttataagattgggaaatttattcgatgtggaataaagtggatgaagtagattataaatatatttgtaatttatgtgttttttttttgttttgattatttttaaattttatttgtaatttttttttattttaaatttgtagtttaaagacgtatatgagaattgttttttagtttttttttattagtattattttattttaagaataatttagctgtaagggaggaatttttttatagtaagctttaaattagtatttttgtttttaattttttattttattttattttattttatatatatagatatttgtttagagtaaaatatatttttatgtgataggtttgtattagctgaggtttatatatttagctatattaggttttgtaattttattattaaattatatatattatattagtagtttgttggtaaagaaggttaaattaatttatattttgtttattatttggtgtttaaatgacgtattttattccggagatttggcggagaattttttttttagattttatagcgttttattgaagataatgtttttatatttgtagtggtttttaatttgataagattttaatttgtttaagttttttaaataagggttttaaatgtttttagtcgtttttttattgaattttttttaatttttttaagattataaagtatatgtgtaaagtaaatatttttttttattgtattgttagtcgatgatttataattaagttaataagaatttagcttttttttgttgaatgtgtttattaattatattttagtttttttttttaaattttagaatagctgtggtttttataatattatgttttttaaagctttattttatgaagggattttattatattaaagaatgaaaaaaatttttattgtagttagtatatatagttttttattttttgttttttaagatttaaattttagagctgtaaatatttttggaagcttgggtgttaatgttttattttagaaagtcgagaagttttatagagttatatagatttttaaatttattttttataaatttatagaattttgataaaagctttggtggttttattttatcgatggaatttttattacgataaatatatatgtatgaaggattttaattagtttttaaagtggttgaaaaatttaagggtacgtgattgttttttatagtgttaacgtgtgcgagatgttggaagtattggggattagtagtagtttagatgtttaaaaagataaggtgttttaatttgtgtggatttattgaagttaagtggtgaataaagataattatttagataatttagattaaagtaaaagtaaaattatatttatttgtatatatatatttatatttattttatattatagatatatatacgtatatatatattggttttgtaaataattgatttaaagtgaggattttttttgtatttttttagtaggagttttaatatttttttaattttttaattattttata

SEQ ID NO: 104 - DNA, 1920 bp, Artificial Sequence
  artificially, CGs methylated, ggcC, agCt, Ccgg synthetically methylated, bisulfite treated
ttaggttgtcgtagatatagtttttgttttttcgaaaaatacgttttaggcgccgggattttagatatttgggaaatagagtgtacgtagctgttgagaggtctcgcgtttggttttttttattattgaggcgtagaggtgttgtggatagtttagatttatacggcgttcgaggtgaaatagaatttttagtttttttatgaggtcattggtattttcggttgtttttagagcttttcgatttagagctgaatgtaaagtaagcgttcgaaatgtagaagtagccggggtcgtttacggtatttgtttcgttcggggcgagagaagacgttaggttgaggttttagcgattttaggtattagcttcgaaggagggcggggagatcgtaaaggggaagtgtccggagggtcaacggtcttcgcgtattttgcgtttttttgaagcgcgtcgttttttcgcgccggggattgggatttgtttttggggaattcgtttagaagacggcggcggattggggtcgggtattttttagggttgttaggtcttttttagttttgtatttgtcgcgtcgttttatttcgttaggaagttttagagattccggggatggggtgggagcgtttttttatcgcgggtttaaaaagaaggaaggacgtttttaggggtcgtagaaggaggattagctttaagttataatttttttcggatttaaggtaggccggttggggtttcgcgtttatacggtctttggcgggggttcgcgcgttccgggagtttcgcggttcggggaggaaagaggagataagagataggcgaggattacggggttgatttagccggggtagggattatcgtggaaaaattttggcgaggtggggggacgcggaaagagagcggtccgcgttttgtattttgcgccgggtatttcgcgttagtgtttcgtttttagtgtttcgcgtttcgcgtttcgcgttttgtttttattccgggtcagctgtatcgcgttcgcgtcgtaggaatcgtggagttggaaagtgggggcgtcgcggttggggggttgttttagctgcgtttcggtcagcgatcggcgggccgggtttaaatttagttaggttgggtaggcggtggtcgcgcgattggggaccgggcgtttcgtttttttcgtttttttttttttttttttttttttttttagttttttggtcttttttagtttttaccggatttgttcgttcgttgtttttttttttttttcgttttttatattattttttattttttcgttttgttttcgtttttttttttttttttgttttttgttttttttttttttttttttttttttaggggcggagcttttttttttttttttagataatgttgtggttgcgttttttttttcgttagctcgtttaggttttcgtcgttagcgatttttccgggttgggggtggggaggtggggggggagtgtagggttggggaggatgagctggttttttttatttttttgttgttgttttttttaagagggatggagatttggtctaagcttttcggtttatccggagctgtgatagttatttttagggaatagttacgttgttttattaagtttatttttagcggtctggattttttaggtagaggttgtgggattttgttttttttaatattttagcttatttttaaaagggtttgagccggataggggttaaataggtcttttcgatttggcgggccggtcagacgtgatagtaatgttaaggaggtcaagtttttttgtttattttttattttttttttttttatttttggattttttggcgtttttagtatatagaggtctttgagtagtccggttgtaggttttttatttatttagagtttttttttttacgtgtttatttttaattttgta

SEQ ID NO: 105 - DNA, 5473 bp, Artificial Sequence
  artificially, CGs methylated, ggcC, agCt, Ccgg synthetically methylated, bisulfite treated
gtaatgttaattagctttattttaaagaaaaattaaatattagagtaaataatgatttttttgcggagaaggagttgtaagggttggggagaggtaattagtgttataaaagttttattataaagaagtttagaatttttttgttttgttgtgtagtagagtgaaatatagtagtagaataattgtgtattattattatgataatttaatttgtttttttagaaaaagttattgtttgtagttaggatagtaggaaaatatttagaaaataattaaaatgtaaataaaagtatgaaataataataaagtttattttttaagagaaaaaaagaagagtatttagcgaaaggagaatgaagtatatataaagtaagtaatttttaggtattttgtttttttggatgttatttgtttaaatttgataatttttataggtagtatgatagattttttaaaatttaaataaagcttgtttttgtattttatttttaataataaagtatattgattgatttataaattaaagtttttaaaattttattaaagtaaaaatattgttttagagcttttattggtatgtttttgaaagtaagtgttatagttaatgtaaatttttaaaaatttttttgttatttagtataatagagggtggattttgtgttagggtggtattttttgtgtaatttatatggtctgaggttttttgttttttttttttttagaagagttggaattaagatattaataattataattgtaataattattattatgtttttaaggggttgttgagtttttggagattttagtgtatagagcgaagtaggagaggtttaaaaaggaaggttttgttgttgatgttgtgatgattaaggtagtttattattattttttttttttaacgtgattgttttgttttttttttttttgattttgttataagatgtggggaagttttttaagaattgtgtatagttcgttatagatggtggtttttgtgtttagagatcgaaagagtatttgttatagcgatattttgtaatagctgtagatgtgcgggtctaaaattgttttatgtgtttaaattaataataattattattttattttattttattatttgagcggaaatataatttgaaatatttaaatttgttttttttaaagctagaaggatatgtgtatgtgaatgtatataatttgtttttttaaatgtttttaaagtttatttttgttattatatttgtttttataattaataaagaaaatttgttttagttttaattttattgggtatggtacgtgttggagggtaggttttggaaatataaatattaatatatgtggtttgttttaaaatttaatgtatttagggttagtttcgttgttttggttaaatgaatgaataaagagtgattaaaatgcgtttattttttcgttattttatatatagtttgagatcgatcgttaatagtagattgtaaatttttgtatttaatagttattaattttttttatagtttgtatatttataaatttaattgggatattcgtttgataaatttagattttgtagagtagatttttaaggaaatttaattttagagaataaaatattttttggaatttttaaggtatttagagataaaacgttttttgtgggatttttttttaagttttataaaagtaggtctattaggattaaattatattaaagttagtgcgaggtaaggggggtgtggtttatagaaattttgggagaaagtttagtatagctttttttttttgggaatatatgttaggatggaaaaaaaaaaaaggaggggagtgttataggattaagatttattttggaaaataagatttttagtaaagatattttttttttttttattttatattagatattagaagtattatttttcgagtgtgttttttaagtttttttttaattttaggttttttttgttttttgggtcttcgattttttggtagctgggtatttgtattcgggtcttcgataggtctagtcgttggtttagtttttttcgtatgaaggcgtcgggatagtgggtttcgttaaaaagtttttttagcttattgagttgttttagggtgaaattggttcgatttcgtttttgtttgattttggtttggtcttcgttttttatttttttcgtattttttttgcgattttttagctccggggatattggagggggtattttagcggggtcatacgtgtatttatacgaatatatatatatacgtatatatatacggacgaaaatagtatagtaaattttgttattagatttgtcgtaaaaaagaatagagaatttttttttttcgtggaattttggtccggttttttaatttatccggaggaagaatattccggagaagcgtaaaggttaagtttgagcggtcgtttggggtaaggtgggtagttatttattattttttttataaacgtatttcgatttatcgttttattatttattttttagttaccggtcttttttagtaaatattaaatggtttttatttattttcgtatttatttgtttcgtagtatttatagaaattaaaggcgtagcgttaggtcttttatagagtaaagtttggatataagggcgcggtaaggtcatttattggtcttttataccggtcatttttagaaggttggttcgtttttaggtcagcttttattatcgttggttttttgtttatcgtaaatttgttggtttaatttaggaataattgggtcgaaaggtattagcgagagtaatagattccggtgttgtgtcgtatagggagtcgtattcgtagacgtttttcgttgtttttgggttcgggtcaaattttgtataaggttttttggatagttaggtaattttcgtttcgtttgttcgaccggggtcgtacgagtataggcgtttacgttatgttggttgtttaaagggttcgtcgtttaagccgggtcagaaggtaggaggcggaaaattagtttccggtggcgggcgaaagtaatcgttttttttgtttttttttcgttttttttcgtggaaacgtagattcgattttaaacgtttaatttatagagattaataggtttaagcggaatattcgcgattttcggtttttattggttgtttaaagtttttttatgtaattagtagctcggatgtttaataaaatatgaatttttttgttttgggtttgtatatattcgttgttatttttttgttttttttttttttttaaaaataggagcttttttagtgtgagtatatatagttattatatatatatttttttggaatttttattttttgcgttcgaattagagattccgggttttaagaagttaaagctgagtttagatagtcgaggttgtttgtagttttttttagcgtaggatttaggtcagtatgggtgttaaaaattatttccggaagagccggtttgtagagaaattaatatttgttttgagcttggaaattaataattttaggaattgcgttcgccgggggtttagatttgaatttcgtcgttaggcgcgttggcgaatttgtagttcgggtctgtagttgtggatttatggccgggaggttgtattgggtattttgacggtaattttattattttataaatttaggaagatttggtgttggtttggaggaagaagagtcgttagatttcggtcttgccgggtattttagctacggtgattttaaatattgtcgtattttttagtttttagagttagttttgtggatatttgttttttttttaggaaggaatattatagtaaatattatgggtcaatttaatagtaaagtatttttattgatattgtattgaaatttaaatatgaaaatatattttttaaattttgttaatgaggtgggaaggttttgtttattatatgttatttatatagtggatgttatttaaagttttggggtttcgaggagatgtttaaattttaagttgatttatagatttaataaaatttttatttttgtttttaaatttttaattattgatttaaataggaatagatcgtgttataaataatttaattgtttgtttaaatatgtgattttacgtatgttatatatttttttaattggaaaaatatggtagtatattagttattgtaggtattaagtgttaaattaattttattgttgaatttttttgaattggtatagaacgttttgttattgagataaagacgttttttaatattgagctagtattaaaggatttttgttttaagagaatcgagtattgggtgattgaaaatattaaaggaattgtgtaaatatagatttttatttttttcgtcgtttttttttttcgtttttaatatattaagaaatcgaaacgtttcgtccgggagaagtagcgtagtttggattttagctttcgttggtttttttttattttgaaagagaatgggaagttttggtctttaagatttaaagatttaggggttttgcggagttcgaggggttttggcggtcttaaatatttaggcgaccggagggttaagctttttatttttgtttttttttttttccggtaaattttgcgttagaggttagctttagtttcgtcgtttggtttagtatttttttttgtagtccggtctcgcgaatttttacgttcgtttgcgggtcatccgggttgcgggtctattttttcgttggtgaaaaatgtatttcggtggaatgggaatatttgggaagggcgcgtataaattttatacgtttttttttacgttatttttataatatattaggattttatttatgatcgagtatattaccggatttttatttttttattattattttagctgataaagctggggtttagggtctttttcgtgtttttttttttttttcgttgggtctcggagttttttttcgttcgagaggagtccggaaggcgggaaggggaatcgttgccgggggttagttaggtcgttatttttcgttagtcgcgggttgtccggttttttgtttttttcggcggcgtttatgtttagcttccggacgggagagcgtttttttttagctttttcgtttgttttttttttttttatatttttttcgtttttttcgtcgtcgttttcgtttttttcgtcgtcgttttcgccggtcgtccggattgccgggttgttgcggtcgtcgcggtccgtttcggtgtagccggtcggttttttggtctcgcgtagcggtccgttttttagtattttccggtacgtgatcgtttttttttttttttttattttttggttaaaagatttggagacgaacgtcgtaagtttttttatcgtcgtcgtacgttagtccggcgtttaatttttgttagtagagtttcgtttttttttttttttttttttttttattgttttagtttttttaataataatatattaatgggataggaggtgggg

SEQ ID NO: 106 - DNA, 1405 bp, Artificial Sequence
  Artificially, CGs methylated, reverse complement  Ca, Ct synthetically methylated, bisulfite treated
gcgggcggcgttctgagcgcaaaacgtgaattcgagtcgtcaagtttgggcgctgctggacggtttcatctggaggtcgtttcgtgtttcactaagtagaggagaaatcgaagagaattcgaagaaaggatgctgcggtctggatcatcagttctagaggctgaattcaaggacatttcttcatctagtttcgatttcattcattcacacagacgcacagggattcaaagcattcggtcgatctggaaagtcagcgatttctgcgagggtgcaaggggcgaggaagagggagcgtttttcagggcagtttcttcgacactcgagcaagggctggagacagcgcaggggacggtcggctcaggtcgaaagcggttcgacagcggttctgttctgggaggaactcgatctgcagtgtgttcgtcgcggggactcgctcagcttcgggggcgtctcgtcactttcggtcgcaggcactcaggtgagcagcgctggtttcgggacatcgatttcttttcatttcgggcgcgaagttcatctgagtaagacttcttcatggtgtcttcgtggtcgtcgctttcaggaaagtgtggcggcgaggcagcggggcgcgcgctttcagggcgctaattctgggtcggtagtaggaaggcgggaagagggggcggttcgtcgtctggagtgcatcgatcgggtttcgtttcggtttcgttttcgtttcgtttcttttcggagatgcgcatagaatttcggttcagtcggctgtggtttcgtttctgattcgttttcttttcgtttcgtgaacgtgcgcgtcgagtttcattttcgttcatttctgcgctgcgctgcatctggcggagcggggctggcgggcgtcgggtctgggagggggcgttttcgcgcggcagcgcagatcagatcagatcaggtcaggtcgggggtgggggtcgtctgcgtggttcgtcgcgttcgcagctctgcattttcagcttttcgcgctggcgtcaatggctggtttcgggagtcgtcgcacttttcagtttcgagttcgggcggggcgggttcggtcaggtggaagcgggcggaggtgcgggcgcttcgggcggtttcgtcgggcgaggcggcggcgtcgggcatcgcggcggcgtcgggcacagtcgggggtcggagtcggggtgtcggcttagtgggtcggggtagggcgggacaggacatctgttctgctacttttctggtaatcaaaagggcagagtgcgtcgattgagttggagtcttagttttctcatctgtaaatgggcgcgttggacagatgatcatttgttctttctgcgctgggcatcgtgcgcagctcggtgtatcggtgcagcggggcagacacagggagtcgttctttacaactcgggtaacg

SEQ ID NO: 107 - DNA, 2365 bp, Artificial Sequence
  Artificially, CGs methylated, reverse complement  Ca, Ct synthetically methylated, bisulfite treated
gcatgtgttcaaagatgttcagatgaggaggtgttgtgggggaggggggcgggaacagcaagttctttcagctctgcagattcagatcttttctttctctgggaagcagggatgcaaagggatagagtctgaaaaagggctttcatcactaagctgacaaagtaactacgatgttttcagctcacactctgcacagcgtcagtggtcactggatcacaattttctttcgtttcttcgtcgtttcacattcttctcaggttcagttctgaagaacagtcactggcactctgcttggcgttcagtcaaagttctggtttttcaggaggtttcgtctttttcactcagatagggctgatttcaggtgggtcgtgtgggcagctgggctcaggacattcagatgtcagttctggttctggtcatggagcggggaggatctcaggctggtcatctttcagcttggtctgacatctggacagtttgctcatttcaacacagtctttttttctttcggttcatcagagggctctgttcaagtcagtctaggagtctcttcgaggggcgggggcttcaggtttcggcagaggcaggttcgtttctcagaagttctgtttcagagcgctggagatcattgtgtgagctttttcttcgtctgctgtatttactttcgcggacgcaggacgcagagtttcagcatcggcagtcaagaggacgcaggaaagcgcacgcactcacaggctcagagacgcggacgtcagattcaggcttggacagagcagtttcgcaagtttcaacacactttgtaaatttcgaagacaggagagagtcaaaatactctttctgttcgcacgcaggtttcttctgtttttcacggttcgattctgggaggcggatgaggatattttcaggtctggatgggggtcatgggacatttcactctagattctgtcacgatctgggctgtgttcgttcggtgctttcggttcacgggctgcacaacttggcggtttcgaaactggcgtgggggaggggagggctgttcattcgagcaggacgcggctgttcactcagtcggaggtgaggaacgatctttctatttcgttgtcgggttcaagcggggttcgagagtcgtcggggagagtcaaagggaggggatcgatggatttttcagagtgaaactgtgcgttctggagagtttcgaggcagtctcgcgagttctcgaggaggtcgctgtcgcttggcaaacacaaacaacaataaaaggaaggaaattcaggcggcagtgcgcagaacgagcacagggttctgtgagggcgcgcagggtctacgcgggtgtttctaacagggtttttcacgtaggcggcgcgggcacggggtcgggggcgcgcggcgctctcagcgggagggcgtctggattaggggtttcgtcttttctcagcgcactttcgtcttttctcagcgcattttcgtttcgcgtcaggttcattcgcagggttctcttcagcacgttcgcggtcgcagcagtcagttcagcattcatcttcgaagttcgaaatgatttcattcagctgcgcgttgatcgcggggttcgacatgatggctggtgggcagcgggtcgcgcggagggcagcggcgaggaagcgttttcggcggggttcgggttctgcgcgctggctggggcgtcgcgttcgcgcttctgcagtgcagagctagtcgtcggaggagtttctaggttttctggctcagctgaatgaatgggggaggaaggcgggcgtcggtttcttttcgcgcgctgcgttttcgtttcgttttcgtctttcgggcggatcaggttttcgcattcgcatcggtctttctgtctcgcactggctgcttcgttcgtctgtcaaggtcaggtctggggggctggggttcgagtggtcgctgggggacagttctgggcacacgatcggagcgtttttcttcttttcgtctggttcgcgttcaggggacggcgagagacgcggtctcagtttcttttttcgggcgtttcgctgcggtcagatgtgggcggatgtggaggtcgggtcatggcgaggagggcgggcgttcagaggggaagagatttcttttctttttcgggcgcagggttcttctgcaggaggctgtatttgggcagtcaaacaaagttctctgtcatcgtcgtcgcgcgctctgcgtctgcaagggttaaacggcagcgcacgcggctggcaggcaggatttcggtctgtgggctcaagagtcgaggggcgcagggcgaacatgcgagtttcatggcatcagcgagaggtcatcaactttcattcatcgagggcatttctgcagctaacattttcatcacgatcat

SEQ ID NO: 108 - DNA, 4261 bp, Artificial Sequence
  Artificially, CGs methylated, reverse complement  Ca, Ct synthetically methylated, bisulfite treated
tatttctctttgtttctctctctctttttttttctttctcttctagtttgtgaggttcagtaaacacagtcaggctgagggcttcaggaagtcactgactgtgctggaggagctgttttctagttctctgctctgttctttcatcgatctcgaggctgagaatttctaagtttcgtttcaggaaacacagtgctcatagtagctctcttagaaattttattggttctggagaaaggaaggcaaactctgtctttcgctcagagttttttcaattctcactgtttttcgttgtcattgatggggaggttcacgtactcaggggaggtcaggaaggtcttgagcttgggtcgggcactgaggcgtttcacatatgctgagagcagggggaacgcattcaggcagtcaggggctaggatctcatggatcagcagcaagttcagcaggttgtagtcagcgaaggagatctgcagggcaggggggctagggactcagtcagcgggagcaggctggaggaattgggggcagagggtctaagttcattttctaggtctgctctgctttgctaaacaaatggctcacatctgtgttcatctggaagcagagggtggcgaggaaggaacagcatggggtcagatgctcatctggtctttcacaatgaaggtcttgtctttctggttctgggacagcagggtctcaaaaggcttcagttgttcgggcagtgtcttcacatagtcattcttgttcgtcttctgtcagacatcatcatgtatcattctactctcatttctttcagtttctgagacattttcgtctgtttcaggtcagacatcagagtttcagattcttctctgcttgcttttcacaatcaggctagtatcaaattctgttcacttcagctgtcaactcatctctatttcattctgtctgttcattcttgctgggttctctcatcagatgattgcaaaagctttagagctggcttctctggaggattcttctagatctcacattcagacacagttctgttcagacttctcaatggttttcattgttcttaggagacttcaaatcagtgggttcaaggtcttcgggatctgggtctactgttcgttcatctctatcttcttattcattcgacacaaatgcaagcgtacacacacacacgcacacacacgcacacgcacgcgcacacacgctgtctctgctgaactggtttcaggttttcaaatgtgctctgtgtctgcatatttttctcagctaaaagtgtcagcatcttcattcagaaactggcgacaaattcttcttcatctctggctacttcaggaagttctcgtcatttcaggagatcagaaatcatcagttgctggaggtctctgttcttgcactcgttttcatgattcgttacttggctggttgatgtttcaggcaataagggtgcaggttgtgtcttgtttcaggtttctgggtttctggttcagagctgattcagtttctgcattctgattcaagaaggggtcagttcaagtcatctgaggggtaaggggggtgagggcacaagaagtttctttctttgttcagttttcagtgttcaattctggtgcagatgctcacatagttggtgtagatgagggagatgtatttgcagcggaggttcttcacgtcgtcattcatcatgttcatcagggctgtcttctgctggttcttttcatagagttctggggttgggtggaggggagcaggtcgcgtgactgggcgtctgatcaacacacagtcactggggatgggtcaatcagggggctgtctgtgagtttcagtctgggaggaggggaagaggatgtgcgtggaaggatgagagactgtcacacagcaggtgctcagagctcatctgacatctgggaggcagtctggcacagggcaaggattgcaggcattcaggcttgatcttgggcaaactacgtaatctcagtgggtctcagttttcttcacttcagagggctgcggggcagctgatttaaacaaaagggcttcgggggcagaggcttgttcatgtctgttctggacttggaggttcaagactcatcaagggtgcggttcaggtgacgcaggatggtattggactggtacagggtgaggtcttcgttctggaacttggggagctgttcgtatagctgttgggggaggcatggctcagggaggggcactgagcttgggcgtttttcgattctagtcacagttttctaaggttcagcattttcttttcttgttcgggcatggtcacttacgcaggaggctttgagtgagttcttctgtcacgtcttcacggtcatcatcttcttctttcagctctggttctgatctgtcagcagcatgcgcagggtcgcgcagcggtctgcggggagggagaagtacgagatgtggggatcgggtcgacttcgtctcgcagcaattcggggaggggtcaggagtgcagggagggaacaggtaaacaggtttcttcgaagatttcacacaacactggggcggggagcaggcatggcgggagaggcggggaacaggaaggaggttcggggtaaaagtcacacgacggagggataagggggttcggatctcttcgggtgggcgaggggctgtgggctgcagtttcagtttctgtctttcttttctgtcagacacatgcttctatctcgaactgggaaatagatcacggtgtagggcggcactgcagcgaacaaagaaaagtttgctggagttcgggggaggatgtcaaggcgcggtgagcgcagtctgttttttcttttcgttttcggggtttcatttcttttcgaggcgcttcgggttttctgaaagtcgctaacggcactggggacgttctgggttttctaggttttcgtttcgggtctcgaggtgggcgaggagttctgtcgggagttcgggtctgatgctgcgggttggtttcatgctgggagctctgagtttcattttcggggagcgggtcgcgcgtactcactggtggcgaagactgcggcggcgaaacttcagcgaaggtctcgcggtcttcgagtcttataagggtggtttcgtttcgcttcgtttcagtgctgagtcacggcgtcggtcgctcttctggagggtttcgcggactttcgtcggtttcagtttcggcggtcgctgcatttcgggcgtcggtcgcagaggggcgttctggagttttcggagtcgtcgcgcagctggtcggggaagtctttttctctttttcaggttttcagcggggtctagggagtaaacagacagcaggaagaggatcgcagcgaagtgtgcgcagcgaactggcgcgtcgggacatcgcggggggaaattttctaagatcgctgcgatttcggagcttgcacattcgcttcacagggcaggggagaggggtggaggtcgcttagaggaaaggaaattgctttattttattttattttattttattttattttattttattattttattttattttattttattttattttattttgtgttattttattttattttatgacgtagtctcacgctgtggttcaggctggagtgcagtggcgcgatctcggcggctcactgcaatcttcgtctctcgggttcaagcaattctgcttcagtctttcgagtaggtggaattataggtgcgtgtcacatctggctgatttttgtatttttagtagagacggggtttcatcatgttggtcgggctggtctcgaacttctgatcttaggtgatctgcacgtctcggcttttcaaagtgctgggattacaggcgtgagtcatcacgtctggtcgttcaacttttatttgaagttctggggtacatgtgcaggatgtgcaggtttgttacataggtgtgtgcgtcatgatggtttgctgtacagatcatttcatcattcaggtattaagttcagtatttcttagctattctttctggtactctttcttttcagcatttcgctcaacaggcatcagtgtgtgttgatcgtcgtcatgtgatcatgtgttctcattgttcagctttcacttataagtgagatcatgcggtctcgctggttttctgtttctgtgtgagtttgctgaggctaacggctttcagcttcattcatgtttctgcaaaggacatgatcacgtttcttttagtggctgtgtcttaggctattttctttggctttgctgtctactttctgttgatttgcagatcttcatttattctagatattgatctcttgtt

SEQ ID NO: 109 - DNA, 6343 bp, Artificial Sequence
  Artificially, CGs methylated, reverse complement  Ca, Ct synthetically methylated, bisulfite treated
tctgcaaaacagaagagaaggaaggctgtaagaagcggcggtcgtcgagtgagcagggctcagatgagactacgttacactagctgttaggcgtctactgtgtgctaggcttcaggcgtgttttttcgatctgacagtctctggcatgtgcagcagcatcttcagtctagtctcgggttcaggacatttatttatcaagaggggatctttcttcagagttgtcgcaaaagtgttcagaggttagaggactataaagtcacagtgtgctggggaggctgtggatctactttcaagaatctcggtgtcggggttaagaactcatctgaacgcaatggcagcgggagtgggtgggtggagaggacttttctctttgggaagctgtatgcaaagatcattcttcagtgcttgttcattagttggagctcggtaaacatttgtagaacatcagcgtcaacgtgtttctgttctagacagcagtttttctcggttttctgtaattctgaaacgaacgggctcttggtctagggtgtttcaggagcgagctgagttcgggtctctcattcatcaggagtcactttttcatatttagtcacactttcttctagagatactaattcggtcatttatttacttactacaaataattattctaaagtatgatttaagatcgcagaggagagacactgggtggactgagcgagactgaggagagcagggcaaacgttcttggagggtttactgttcgtcaaggacggagaaatagctctggtataactgctattcagttctttttctttctctttcgggcgagtcaaatctttttcacgttttcaatcacaacgcagcgagtcaagcatttaacgcgctttttcttctctgtcacaggcaagtcgggagaggtgggtctcgaggggcttcatcgggtgggtagaagagtcgcggttgctttaaagacaagaaaagaaggttcagggctttctaggtttcttcgatctcagcgtctgtctctcttcacgctaatcagggtacgtcgacgatcggagggttcacttcgcgcgggtgcggggatcggggtgggagcaagcgttgtcgggttggcggaggcacagaggcggggcagggagctgcgggtctgtctctggtctgagtatcgtttttctgcgtctcggtctcttctgaagggagctgggttctggggagtctctggtcaaggtcgctgtctacaggaggggctgttcggcgctgtggcgtggggattcagggtggggacggtcaggcggttttttcattcgctagcgagaacgcgggcggggactctgtcgattcgattcttgtgggttcgtgggttcagaagtagcagtttggcggcttcagatttagtgattctgcagtaaaatcacaggattagtttctgattgagatgtctgttcgtgagatattacaaaattcattatcacagctttctactaactcgatatgaagtaacacagatgggattttattagttcagacttcaaatgtttacttatgataatttcggaggaaatttgcatgtcatcatcatttcgataatcttttttttttatatgtctgaactggctgcattattagctggtagtcggagcactgcagatggtaactgcaaatagtttttatttatttattttttttaaagaatgaaatatacaaaagaaaaagattgcgttgcttggtgtaaagtcagtcaattattacacattctttttttcactttttcgtgcttcagtgctgaagatcaaacaaagcaatacaaaacaaatcttcaagaactcatagagcttcactctaaggactgaaaagaaggtcaaggcgtgtttcttagctcacttctacatgttcttgtgacttggagatttattttgcagtcaaaatgagtcttgagacttgcatttttatgcttcatttaatgatcaggtctactagaagaactgagtctaaataactggggaagataattttttaaaaagagatcttcaattttcgtctgctgattcttaaacttgttctatcaagacaagtcttctgtgagaaatttggctgtcagacttcggaactggcttcaatggctaatctcacaaattgagatgggagactttttctgatgggaggtagttctcattttcaaagttcatgttctagttggaatgtatatgtcaaggactcttgttttggtcaacttgggttttatattgtgagcacacaaaaagcactacacggctaacggaggacgaggaatcatggcaaagcaggcaggcaagttctaagaaataaaacaatttgctaaaaaataatttctgatgactatcgcaagactgaaagtgcaggaaaaatacagttcgaataatttcagattctttcacattttttttcttttcatacactttgttatttcataacaaaatctttaatggaaagtttaaaaataaacagcacaggaacatgtgttttaaatgaactaaattgtgaaattagtcagtaaattaatttgtagtaagtaattatttaaggaaattaaaatactgctcagttcagttctgtattttatcatgtgtatgcgttctttacaatcaattaatataagtgctttaggaacatttgaagacaaacacgcttaacttaaggaacaaagcatctaaataatttaagtgtaattttgctgagttaaagtaaaacatttcacaaatgaagtggctatttaattttttagggaaagtttggttattgaaatgttgtatgctcatgttacatcaacaaaaatcttcaatttattttgcttatgtgctttgttttcttgatattattggtatttgaattttagatggatttctgtcaaaatgatattttgtgtgataaaagcatctttagttttgattgatagactaaaacaaatgcaaggaaatttctttaaatcagattaatttttcataaaaatattttagaatgtatgaattctgatatttacatttataatggtaaaagtttttttcgtttagtttagtaagacaatactcacacaaaagagtaaaaaaaaatcacatcatcttatgatagtttgatttctaaattgcttaagaaagtaaagtggttaaactggaaaagaggaacatatttcggaggtttagaatcgaaaatttttttcttaatcttcagctggaaaataattctctgcattcatttaaagtgtatcttctgaagtgtcagattggagttgactggtgatcaatttaaaggagttacaattcaaagaaatggtgagagcttggcattcaggtctggctttcaggtaattcgcttgggtctgagaggtcactaactgtcagttaagatggaatctttttcttttcttttttttttcaatggataacaatgggaagggggctaatctttcagtagctgaaactttgtattcagttctttatcttgagaatgctaattcttggttcgaggatttgtttctgcagtgttggcatcgagatttaagggaagatatctcgttttaaatgtcagtcacggtctggcttttctctcgacttcagcattctgtagattgttagtgtctgtggcgggggacgaaaggaacagggctttgcaaggtctgtttgtcgactgcgttatcttgggcgaaacttagtttcaaaagtcacaaatcatctacggtgaagattcttcgaagtggaacaaattttcagactcgcattatctcacatttctgcgggatagatggtcttcacttatcggctatcgggagagagctgctgtcttcgcgtttcactgcttttcggggcgattttcagcgagtcgagtcttcggctgcacggcaagcgttcgaaagtcgggtctgagaggactgcagggcttctgagggtgtcaagtttcgaaggagttcacgggtgcactggggtcttcgaaatctagtcgtcactggcagtttctttctgcttctcttcagctttctcgctcggtctcgcactctctcttctctttctttctctcatttctctctcttttctctgcttctacttcgtgtggggagtgacgtgacgtcagcagagatttcatcaaacttcactgcacagtggcgcgcgggcgtcggcgagttcgctgcgcggctggcgattcaggagcgagcacagcgttcgggcgagcgtcggggggagcgagcaggggcgacgagaaacgaggcaggggagggaagcagatgtcagcgggtcgaagagtcgggagtcggagtcgggagagcgaaaggagaggggatctggcggggcacttaggagtcaatcgaggagcaggagcacggactttcactgtggaaaggaggatcagaagggaggatgggatggaagagaagaaaaagcaatctgcgtcaattcggcagttctaataaatcaaagggggagcgtcagggcagcggggagacagaaacgtacttttggggagcaaatcaggacgggctgggaggaagcgacagggaaagtggttcaagagacggaacaaaggacaatgttcatggggttgtttgggacgaggcgtgtggagtgtgggtgtgagcgtgcgtgtgtgatcttctttcaggtctgcagagttgaggaaagaggtcacagcaaagagggactgcggagggaggaaagtgagagatcggtagagggcgggagtggaggtgggcgcggtggggatgggagaggatgagtgaagagaaatctagaagaatggagtgagctagtgggagagggtgggagggtcacagtcgggagcgaacgagctaggcttgtcagctggggaaggtcgggacgctgggttcagcttagctgggacatcgcgttcgaggtcaaggcgggtggatcaggcatgctgagagtgtcggcgcacaggtgggcacggtcacgcactgattcagtgttcacgaagggtttgcactggacaaggctcagacgctcatagagtctagaattttctctgctgtatctacattcaacaagttcattctgggtcacggatatctcattttttaaaatgacgaggttaaggtttctggcgaggatggtattaaattgcacgggatagaagtgggggtgggggagagagtttttctcaagttcacatttgcttctgcaaagcaaagagtatgtgaaattacagggcatattctcactcgaaaagtgtgtcttacttctgaattctgattttctgatttcttgacttgagcaaagatgtgtattttggtagtgagcagaatattttggctctgttctgtctctgagtggaaggactataaatataattcgtctggaggatcaggtgtgaaggcttctgtcaggcatatgggacaatgttttttcaatctcaagggcattctgttaatgtatgtttttggaaagtgtcggaacacagtcattgcttctggattcggattttttcatcaatattaatttctgcttgagagcaaaactcaggttcgctattaaaaagacatctctttggtttctaattgagaataaagttttctctaaaagttgtattgctctttctaaatcaatatatcaatactcgcaattttagaaatatatagtgactcgggagaatgtgcataaaatagatacgtttaaaaaagcttggcgcttaaaactaattctagtcactatataggtgctgggctttttctacttttgggggctgtctggaacatgttatgtgttttcttgaattacttcgtgttttgaattcatttgagttagcagtaaaaacaggcaaacaaacttgctcaatttgttttgagtgctaaatttcttcactttgaaatagctaacagtcgacagatggactcattttatggaaagggttagtctcttcagtcacgaagaaaactgattagagatctacattttaagtcatttctaatcttcacgtaacattcgtgaaaactcaaactttctctctttattcagtggaaactcaaagcagtgttatttaaggggagagaaatgagggggaaaatgttcacgtgctgtttaattgtattttctctctgactctgagaatttctatttctggtttttgaaatctcgtcgaggcaagaaaatcaaatttcttcaacaagtttcacaactgaactctagttacaggacatcggaaagtgcagttcgagaaagacatcttcatctctgttcatcgacgatttttgcagtcttttcatttctctgagtaatgggctaataattctttctttttttcttttcattttgtagagattaagaggcgctcgtagcagaacggtcttgtcttcagctggtggcgaggataggcaatt

SEQ ID NO: 110 - DNA, 9001 bp, Artificial Sequence
  Artificially, CGs methylated, reverse complement  Ca, Ct synthetically methylated, bisulfite treated
tgtaaagtgattaggagattaggagaatgttgaaacttctgctggaaaaatgcaaagaaaattctcactttgagtcagttgtttacagagtcagtgtgtgtgtgcgtgtgtgtgtctgtaatataaaatggatgtgaatatatatatacaaatagatatggttttgcttttactttaatctgaattatctagataattgtctttattcatcacttgacttcaatgggttcacacaaattaggacatcttatctttttaggcatctaggctgctgctgattttcagtgctttcaacatctcgcacacgttggcactatgaggagcagtcacgtgttcttgggtttttcaatcactttggaggctgattgaggttcttcatacatgtatatttgtcgtgatgaaagtttcatcggtagagtggagtcatcagagcttttatcaaaattctgtgggtttatgagagatgggtttagaaatctatatggctctgtggggcttctcggctttctaaaataaggcattaacattcaagctttcaaaaatatttgcagctctggggtttgaatcttgaaaaacaaggagtgaggggctgtgtatactaactacagtggagatttttttcattctttaatgtgatggagtttcttcatgaaatgaagctttaaggggcatggtattgtggggatcacagctattctgaggtttaaaagaagaaactggaatatgattagtaaacacattcagcagaaaagagctggattcttattgacttagttataggtcatcggctggcagtgcaatgggaggaaatatttactttacacatatactttatgatcttgggggaattagaggaaattcaataagaaaacggctagaaacatttaaaattcttatttaaaagacttaagcaaattagagtcttatcagattaaaaatcactacaaatgtaagagcattgtcttcagtgaaacgctgtggggtctgagaaggagattcttcgtcaaatcttcgggataaaatgcgtcatttaagcatcagataatgagcagaatgtaaattaatttaatcttctttatcaacaggctgctagtgtaatgtgtataatttagtgataagattgcaggatctaatatagctggatgtatgagtctcagctaatgcagatctgtcacatgaggatgtgttttactctgagcaggtgtctgtatgtgtggaatggggtaaagtggaataaaaggttaaaagcagaaatgctgatttaaagcttactatgaagaaatttctttcttgcagctaaattattcttaaagtgggatgatactggtgaagaaagactgaaaaacaattctcatgtgcgtctttggactgcaagtttaaaatggggaggagttgcagatagggtttgggggtggtcagggcaaaggagagacacataagttgcaaatatatttgtagtctgcttcattcactttgtttcacatcgaataagtttttcaatcttgtgaacaaggacaaggagggagtgttttaaagatacttcatgctggcattgcaaatcattgactgtaatgtcaaacaaatacacattcagagatgataacactaacttcatagtaaaacaatcgttcatgcagaaattcagaggagattagtttgttctcttcagctgatctatgctgggggacaaaaggactttcaaaaattattttgaatatgtttggatttctttctttaatttctttggaaattaaatttgcttggaaacagtgctataaagagttgatgtcttcaaaggtgattttttttgttttatataaataaggttttgcttttgctagttgagcgcagttctaggcttttcgttcttagctcacacacatttcttctgtctgcttggactttaatggctcaagacagtcttgagctcactgggaaaagaaaatgactgttaaaaattattcttgaaattggttatttggcaacattcttaattgtatggaaattcattaaggcatatttcatatataattagctcaaggttgttgattctacaggctttatggatttaaatctgattgataataaagtaaacaagagagtcgaatttaaagcgtggctctctcgggttaggacgagcttaatacagtgtacaaggaatttgaaagatctaggatatgtgtcttaatcaacgttaagtagaatggataagctttcagcattttgaaaacgctgggttagggtttctcttctattgtgtgttttctgtctggggactaataagcatcacagagaacgtgatctgaggcgactttttattcttgtataaattcagagtgaatcatcaaacagttgttcgtttaaagtcaaggtaattttcttttgacgggttcatttgcttctcgatttctaatttattagtctgtcttttcagggctctgtcttctttgcaattaaagcttcttcagattagcgcagcattcacttgacaggctgtttggaaaatttaagatcggagaggtgatttgttgctgtttttcaaattttctagttttaagtaacgtgtcttctttttatatggggtgggggattggaaatggatgtagtgagacacaaagagtgggtgtcttgttgattcttgtatctttctcttcttgatcatttcactctcttctttcaagtcttcgacttctagtctcatctcttcatctttgggttcgtactaaaagtcggatcgtcttgggctgggcaggagctgaattttcgggagcttgtctgtgtagattcagtgcgcacggcgaggcagtagttcggtttcgcactgctgataggtgcaggcaggacagtttcttcatcgcggctcggggcgttctgattggtgcggagtcacgtcagtcgcattcggagaagggtctgggaggaggcggaggcggagagggctggggagggtcgcggcggagtgacgtctcggcatcaggaagttcgtctctggttttaagatgttaggtcaacagggaagcgcggagtcgcagatctggttcgtcgctcgtctgggtgtctggagctgagctgcggcaaggttcggcttctgttcgatcgttcgaggggtgtgcgtgtgcgcgttgcggagggtgcgctcagagggtcgcgtcgtggctgcagcggctgctgtcgtcgcaggggatctaatatcatctatctgtttctgtcactcttgacacttctctgtcagggctgtcgcgtggggggggggcgggcagagcgcggtcggcgttagcttttcttattggaggggttcttgggggagggagggagagaagaagggggtctttgttcactcttgtttcgctttggagcttggaagtctgctttctaaagacgctctgagtggtgttcttctgttcacatttcatgtcttcgtttgttcgctgacttttcgtcttcggactttttcgcttgagtctttcggaggagacgggggcagcttggcttgagaactcggcgggggttgcgttttctggctcttttcgcagcggggaaacttcgcgtctagagcgcgattcggagcgggcagcggcggctacgggggctcggcggggcagtagtcaaggactagtagagcgtcgcgctttctcgttcatgaactgcatgaaaggttcgcttcacttggagcatcgagcagcggggatcaagctgtcggtcgtcttctcatctttctgtcatcattttcagtcgttagtcatggcttcggttctggctttcggtcagtttcggtcgctggacttcttcaagcacaggctggaggtgcacatcatcttcgacatcttcagttcggaggtcgcaggtaaggcgtcgcgtcgttctgcagacattttcgctcagctgctctgcgtcattcgctttctctcgtttcaaggaagtcagtttcttcggggggaggcgtggtgggagtggtcgttcgtctggcttttcgcagaactttcgggagtcggaattttgactatttcgcatttctttagttctttctcgatcggttcggcttctggggcgctaagggcgcgagcaattctgtcgttctctctattcgtattctggtctttcttctgttttctgggtcacaaaaatttcagcatcttgattcgaggatcttcagaggtcgtcgatctctgtttctgtttttctctcggctttcagctttcgaggagcttcactcgttaggaaattgtctgaaatcactcagaaatgttcttcgcgaagaggcattttttttttttttttgggaaagggtcggcgaacttcggtgttcaatcgaattttcacatctttttctagtcttttcaaatcgcatggaaatctgagctttctgcgagggggaggggggtctgtaaatcacgcgcgtgtgcgcgtttcaggagatttggtgtgtctgcgcagaggtgtataaatatacttgaaagcacaggctataaaagtgaatgtgtcgctgcagtgagataaacatgtaaataaaacgtgcggcgctgggggaggggaggaaatggggcgcggacattcacacttgcgtctgcacatttcacaggcgcagcgcttctcgcggttcggagtcgtcgcgcgcattcttcttcggcgtcaggcagttcagctctttcacggcttctgtcgtcggttcagttggcgttcgcgttgcaggtgggcatgctgacgggaaagtgtgtgtgtttcgttttcagagaaagataaaagtcagcaggggaagaatgaggacgtgggcgtcgaggattcgtctaagaagaagcggcaaaggcggcagcggactcactttatcagtcagcagcttcaggagctggaggtcacttttcagaggaatcgctattcggacatgttcacacgcgaagaaatcgctgtgtggatcaatcttacggaagttcgagttcgggtaggagtcagcacggagtctgggagggatggggggaggatgttgtggaggtacaggtcaagtagatcaggagagaatgtggaaggcagcgtcgtctgggagggcgtcggtggggcgcagctttgcaaaggcagaaggtctcgcggcggtctggttgcgagattacagttttctcttcgaggtcgacaggactgtcgttctggctcaggctttcagagcggcatcggctcactgtttcgtcatttcgcgatctcacgagctgggctgcatgggcaattttctgcacaggacattgtgtttctggcttgcagttgtcagagcagagctaataaaatttctatcaggtcaagagtcgcgaacaggcttcaatctgtgagtctttaacaaggaaaattcgtcagagacacggaagagttggttctttctgggaaatctttgtttcggttctggttcagctttttttcttctgggctcgcgcttcttacatcttctttacggttgtttcggtcattcaggtctctttcacacattctattttctagttttgtgatcttcgggagcaaagttttaatacacaactactagttctcttagaaggagaaagaaaaaaagaagaaagacttttctgcttggtttatttatcttctctcaggagttgaactctggaaattgaaactcacattttctcttctaaattataatcatagttttgtaaaaagggcttatcttaactttgtagcaaatctgtactttatggattggcaaaaatgagctcaaataaataattcaatagcaacgttctggtttatgctggtcggtggaagatttcaaatttgttaggattctggaagcagaaaacagaatcaagcaaatcaagcggcattcagaggctttgctgttaaaaaaaaaaaattaagtgctctgggtagaaaaaataaagttttcggttagagcagagcaaacaaaaagaagaaaacaacgataaaaagaataaagatcaaaatgctctttcaaatcagagggaatgaagacactctctgggtggcatttgtgcaaggcatgaggctatgctggtggataaaaggtcgggaagaagttgaaaatggttttagtttaactgttcagagtcagagctgggttctgggcggcgtggttttgagcaaggtcagtctttcattagctctcttgcacatcaagggaacgggtctctcacgtactcttctcgtctgagcaaagtttagatggtctagggtagaaatggcaagtaattaaagacagagtctatgggttttctgggattcttcgaaaacgttctttcatttcgttcgctatttcgcagcttcattctagtgctttgtagtcgcggcgctgggctcttcttgcagctgtctcttctttcagggcggctgcttgtcgagtcaagtgggagtgaggcgtgctttttatagcagtcgggtgcaaagaggaagggggataaaaaggaaatcaagaatgaaaggaaaaagagaaaaagcggattacacggctgggttcggcggagatgtgtaatgtgaaacatcactggtgtcagctcggatatctcaggtcaggtctctcttcaatacacaaaagtcgtcgtctggggcgacagggaggttcgatgtggattgggatcggggttgcggctgggtcatcggacacgggtggaagtcggtcggtctgggtggtcgtctgcaaagtcaaacgattcggctgggtctggcgcgcggacaggtctgtggtgggcttagggtaaagaagaggcagagcgaaagaagggggaatcttcaaaactattcttttcgggttttcggagtttaatatgtcaagcttctggagttaacgagctgacgaagaggtggtcttttgctctttatttggttgttttgctaggcgagaaagagtgttggcggtctagtttctgttaagggagcacgtatcagggggtgggggacgacagtggaggtcagggaaggaagggaggaattgcgtgggagaaagagcgattctctagtgttctttcagtttcttcttctcattcgtgggtctgtggctttggaatggaagcaagtttgcaaggtgtttcgggaagggttggaaaagtctgctgtttcgcgtttgttttacattaagtgtttttggatctggagaaacgtctggctgagtgatcaaatcgttcgcaggtcttcatgcgttcggctgaggtttgtggcgtagcttcgagtttcagctcgcaggtcagagcagatcaggtcttctgcgcttggtggagattcgggtcagtaactgaaagctggttctggtatcttggtgtgcagggcggtgcagtgaagcgaggtcagggtgtgtgagtgcgctagcgtgtgtgtcgggggaaggcgggggttggtcttcgatggaagttttagtaatctgcactgtggcatctgtttgctttcttgtttcaatcgttttcaggtttggttcaagaatcgtcgggtcaaatggagaaagagggagcgcaatcagcaggtcgagctatgcaagaatggcttcgggtcgcagttcaatgggctcatgcagttctacgacgacatgtattcaggctatttctacaacaactgggtcgtcaagggtcttacattcgtctttctattcatcaagagctttttcttcttcaactctatgaacgtcaattttctgtcatcacagagcatgtttttttcattcaactctatctcgttcatgagcatgtcgttcagcatggtgttctcagcagtgacaggcgtttcgggcttcagtctcaacagtctgaataacttgaacaatctgagtagttcgtcgctgaatttcgcggtgtcgacgtctgtctgttcttacgcgtcgtcgacttcttcgtatgtttatagggacacgtgtaactcgagtctggtcagtctgagactgaaagcaaagcagcacttcagcttcggctacgtcagcgtgcagaattcggtcttcaatctgagtgcttgtcagtatgcagtggatcggttcgtgtgagtcgcattcacagcgtcgggattctaggatcttgtcggatggggcaacttcgttcttgaaagactgggaattatgctagaaggtcgtgggcactaaagaaagggagagaaagagaagctatatagagaaaaggaaatcactgaatcaaagagagagcttctttgatttcaaagggatgttctcagtgtctgacatctttcactacaagtatttctaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgtcacactgtatgtttctaacatattattattattataaaaaatgtgtgaatatcagttttagaatagtttctctggtggatgcaatgatgtttctgaaactgctatgtacaatctattctgtgtataacatttcgtacaatattattgttttacttttcagcaaatatgaaacaaatgtgttttatttcatgggagtaaaatatactgcatacaaattggtctggattctttcttttcttctctgtcactaacttggtcaggacatctcagtcactgctttctaaacaaatcagttttctctgtctgtctagttaaacatacaaggcagcagttcttatttaaatttggtagaaataaatgatagtcattcatcagaaactaaaaagaaaaaaaaaggcattttcgggggggaaaagggctacaaaatctaattttgtctcttcaatttttctttggcttaaatctagaggatttcattatggctagcaaataatatgaaaaagaaaaaagaagaaagaaatttagcaagttcatcagct

SEQ ID NO: 111 - DNA, 1920 bp, Artificial Sequence
  Artificially, CGs methylated, reverse complement  Ca, Ct synthetically methylated, bisulfite treated
tgcagggttggggataggcacgtgagggggagaactctgagtagatagggaatctgcagtcgggctgctcaagggtctctgtgtactgggggcgtcaggaggttcagggatggaaaagggggaggtgagaaatggacaaagaaacttggtcttcttggcattgctgtcacgtctggtcggttcgtcaagtcgaaggggtctgtttagtttctgttcggctcaaattcttttgggaataagctgggatgttagaaaaaacaaaatttcacaatctctgtctggggaattcaggtcgctggaggtgggcttggtagggcagcgtgactgttttctgggagtggctgtcacagcttcgggtgaatcgaggagcttgggtcaagtcttcatttctcttggagagggcagcagcaaggaggtgaggggagtcagctcattcttttcaattctgcacttttttttcatcttttcattttcagttcggaagaatcgctggcggcgggagtctggacgagctggcggggaaggggacgcagtcacagcattgtctgggagggaggggagaagcttcgtttctagaggggaggggagaagaggagggggcaggagacaaggggaggaagaaaggcgaaggcaaggcgaaggggtggagagtgatatgaagagcgagagaaaagagaggacagcggacgagcagattcggtaggggctgaaaaaggtcaaggggctggagggagggagaggaaggaggaggggagcgaggagggcggggcgttcggttttcagtcgcgcggtcatcgtctgttcagtctggctggatttgagttcggttcgtcgatcgctggtcgaggcgcagctgaagcagtttttcagtcgcggcgttttcacttttcaacttcacggtttctgcggcgcgggcgcgatgcagctggttcggggtgaaggcaaggcgcggggcgcggggcgcggggcactgggagcgaggcactggcgcgggatgttcggcgcaaggtgcagggcgcgggtcgctctcttttcgcgttttttcatctcgtcaaagttttttcacgatggtttctatttcggctgggtcagtttcgtaattctcgtctgtctcttgtcttctcttttcttttcgagtcgcggggctttcggggcgcgcggattttcgtcaggggtcgtgtaggcgcggagtttcagtcggtctgtcttgggttcgaagaaagttgtggcttggagctagttcttcttctacgatttctgggggcgttctttcttctttttgagttcgcgatgggaaggcgctttcatttcattttcggggtctctgagactttctggcgaggtggggcggcgcggcaggtgcagggctggggagggtctgacagttctggagagtgttcgatttcagttcgtcgtcgtcttctaggcggatttttcagaggcaggtttcagttttcggcgcggggaggcggcgcgcttcagaggggcgcagggtgcgcgggggtcgttggttcttcgggcactttttctttgcggtcttttcgttcttcttcggagctggtgtctgaggtcgctgggatctcagtctggcgtcttctctcgtttcgagcgaggcaggtgtcgtgggcggtttcggctacttctgcatttcgagcgcttactttgcattcagctctaagtcggagagctctggggacagtcgagagtgtcagtggtctcatagggagactgagggttctgtttcatctcgggcgtcgtgtgggtctgggctgttcacagcatctctgcgtctcagtgataggagaagtcaagcgcgaggtctctcaacagctgcgtgcactctatttttcaggtatctggaatttcggcgtctagaacgtgtttttcgggagagcaaaggctgtgtctacggcagtctgg

SEQ ID NO: 112 - DNA, 5473 bp, Artificial Sequence
  Artificially, CGs methylated, reverse complement  Ca, Ct synthetically methylated, bisulfite treated
tttcatcttctgtttcattgatgtgttattattgggggggctggagcagtaaaaaaagaagaaggaaaaaaagagcggggctctgctggcagaggttgagcgtcgggctgacgtgcggcggcgatggaagaacttacggcgttcgtcttcaagtcttttgatcagaaagtgaaggagaagaaggaggcgatcacgtatcgggaggtgctggagagcgggtcgctgcgcggggtcaaggagtcgatcggctgcatcgaggcgggtcgcgacgatcgcagcagttcggcagttcgggcggtcggcggaggcggcggcggaggaggcggaggcggcggcggaggaggcggaggaggtgtaggaggaggaggagcaggcggaggagctggaggagggcgctctttcgttcgggagctggacatgggcgtcgtcgagagaagcagggagtcgggcagttcgcgactgacggagggtaacgatctgactgattttcggcagcggtttttcttttcgtctttcggacttctctcgggcgggagaggacttcgaggttcagcggggaggggagagggacacggagagggttctggatttcagctttgtcagctagagtgatagtggaagggtgggggttcggtggtatgctcggtcatgggtggggttctagtgtgttgtgggggtggcgtggggggaagcgtgtggggtttgtgcgcgttcttttcagatgttttcatttcatcgaaatgcatttttcatcagcgggaggatgggttcgcagttcggatggttcgcaggcggacgtggaagttcgcggggtcgggctgcaggagggggtgctgaatcagacggcgggactaaagctagtctctagcgcagagtttgtcgggagggagaaggggcagaggtggaaagcttaattcttcggtcgtctaggtgtttggggtcgtcaagatttctcgaacttcgcagagtttctgaatctttggatcttaggggtcaaaacttttcattctctttcaaggtagaaggaagtcaacgaaagctgaggttcaggctacgctgcttctttcgggcgaggcgtttcggtttcttggtgtgttgggggcggggggggggggcggcgggggaggtggggatctatatttacacaatttctttagtgttttcaatcattcagtactcggttctcttagagcaaaaattctttggtgctagctcagtgttaggaaacgtctttatctcaatggcagagcgttctatatcaattcaaaggagttcaacaataaaattgatttggcacttggtgtctgcagtaactggtgtactgtcatattttttcaattaagaaaatatgtggcatgcgtggaatcacatatttaagcaagcaattaagttgtttatgacacggtctgtttctgtttagatcagtaattggaaatttggggacaaaaatagagattttattaagtctatggatcaacttgaaatttggacatcttctcgaagtttcaaaactttgagtggcattcactgtgtagatgacatgtaatagacaaagtcttttcatctcattggcagaatttgaagggtgtgttttcatatttaaatttcaatacaatatcagtaaaaatactttgctattaaattggttcataatgtttactataatgtttctttctaaagaaaggacaaatgttcacaaaactaactctgagaactagaaaatacggcaatatttaagatcatcgtagctagaatgttcggcagggtcgagatctagcgactcttctttcttcaaatcagcatcaggtctttctaaatttgtaaagtggtggagttatcgtcaaggtgttcagtgcagtctttcggtcatgagttcacaactacaggttcgaactacaggttcgtcagcgcgtctgacggcgaggttcaggtctgaattttcggcgggcgcagtttctgggattgttgattttcaagctcagggcaagtattaatttctctgcagatcggctctttcggaaatgatttttaacattcatgctggtctggattctgcgctgggaagaactgcaaacagtctcgactatctaaactcagctttgacttcttaaaattcggagtctctgattcgggcgcagaggataaaggtttcagggggatatatatatggtggctgtatatgctcacactagaagagcttctgtttttaaagggaggagaaggacaggaaagtggcaacggatgtgtgcaaattcagagcagaaaaattcatattttattaaacattcgagctgctggttgcatgaaaaggctttgagcaatcaatagaaatcgaggatcgcgaatatttcgcttgaatctgttgatctctgtgggttaagcgtttagggtcgagtctgcgttttcacgagggagggcgaagagagaacagaaagagcggttgctttcgttcgtcatcggaggctggtttttcgtcttctgtcttctggttcggcttgggcggcgagttctttgggcagtcaacatggcgtgggcgtctgtgctcgtgcgatttcggtcgggcaggcgggacggagattatctggctgttcaggggatcttatgcagggtttggttcgagttcaggggcagcgaggggcgtctgcggatgcggctttctgtgcggcacaacatcggggtctgttgctctcgctgatatctttcggttcaattgtttctaaattagatcagcaagtttgcggtaggcagagagtcagcggtggtgagagctggtctgagaacgagtcagtcttctgggaatggtcggtgtgagaggtcagtgggtggtcttgtcgcgttcttatgttcagactttgctctgtgagaggtctggcgctgcgtctttgatttctgtgagtgctgcggagcaagtgagtgcgaaagtgagtggaaatcatttggtgtttgctggggaaggtcggtgactggggggtgaatagtgaggcggtgagtcgaggtacgtttgtgaaggaggtggtggatgactgttcatcttgtttcaggcggtcgctcagacttgatctttgcgcttcttcgggatattctttcttcgggtgggttgagaagtcggatcaggatttcacgagggggaaggattctctattcttttttgcgacaaatctggtaacaggatttgctgtgctgttttcgttcgtgtgtgtgtgcgtgtgtgtgtgtgttcgtgtggatgcacgtgtggtttcgctggggtgttttcttcagtgttttcggagctgaaagatcgcaaagaggatgcgaaagggatggaggacgaaggtcagatcaaaatcaagcagaggcgaagtcggatcaatttcattctggaacaactcaatgagctggagaggctttttgacgagattcactatttcgacgtcttcatgcgagaggaactgagtcagcgactgggtctgtcggaggttcgagtgcaggtattcagctgtcaggaggtcgagggttcagggagcagagagagtctggggttggaaagaggcttgggggacacactcgggaggtggtgcttctagtgtctggtgtaagatgagaaggaaagagatatctttactagaggtcttatttttcaaagtagatcttagttctatagcacttttcttctttttttttttttcattctaacatatgttttcagaagaagaaagctgtgctgggctttctttcagagtttctataaatcacatttttcttgtctcgcactggctttaatgtggtttaattctaatgggtctacttttataaggcttaaaaaaaaatttcacagaaaacgttttatctctggatgtcttaaaagtttcaaagagtattttgttctctggagttggattttcttgaaagtctgctctgcagggtctaggtttgtcaagcggatatttcaattaggtttatagatgtgcagactataaagaaaattagtaactgttaagtgcagaaatttacagtctgctgttagcggtcgatctcaaactgtgtgtgaaatagcggagaaataaacgcattttggtcactctttgttcattcatttaatcaaggcaacgaaactgattctaaatacattagattttaaaacaaatcacatatattagtatttatattttcaaagtctgttcttcagcacgtgtcatattcaatgaagttaggactgaaacagattttctttattggttgtggaggcaaatgtaatagcaaaaataggctttgggggcatttaaaggagcaaattgtgtacattcacatacacatattcttctagctttagggggaacaaatttaaatgtttcagattgtattttcgctcagataataaaatagaataaaatgatagttattattggtttgaacacatggagcagttttaggttcgcacatctgcagctgttacaaagtatcgctgtaacagatactctttcggtctctgggcacagagatcatcatctgtagcgaactatgcacaattcttaaggggctttttcacatcttgtaacaggatcaggaaaaaaaaaaacagagcagtcacgttgaagaggaaaagtaataataggctgtcttggtcatcacagcatcagcagcagagtctttctttttaagtctcttctgcttcgctctgtgcactgagatcttcagaggctcagcaatttcttaaaaacatgatgataattattacagttatgattattagtatcttaatttcaactcttctaggggaaaaaaaggcaagaagtctcaggtcatgtgaattacacaaaggatgtcattctggcacaaaattcattctctgttgtactaaatagcagagaaatttttgaagatttacattgactatgacacttgctttcaaaaacatatcaatgaaagctctgaagcagtatttttactttaatggggttttaaaaactttaatttgtgagtcaatcaatatgctttattattgaaagtggaatacaaaagcaagctttatttgaattttaaaaaatctgtcatactgtctgtaaaagttgtcaagtttaagcaggtaacattcaggagaacaaagtatctaagagttacttgctttatatatacttcattcttctttcgctgagtgctcttctttttttctcttaagaagtgaactttattgttgtttcatacttttatttacattttagttattttctagatgtttttctactattctaactgcaaacagtggctttttctaaagaagcaaattagattatcatgataatggtgcacaattattctgctactgtgtttcactctgctgcacagcagaacagagaaattctaaacttctttgtagtgaggcttttatgacactaattatctcttttcaattcttacaacttcttcttcgcaaaggagtcattatttgctctggtgtttggtttttctttaagatgaagctaattaacattat

SEQ ID NO: 113 - DNA, 1405 bp, Artificial Sequence
  Artificially, CGs methylated, reverse complement ggcC, agCt, Ccgg synthetically methylated, bisulfite treated
gcgggcggcgttttgagcgtaaaacgtgaattcgagtcgttaagtttgggcgttgttggacggttttatttggaggtcgtttcgtgttttattaagtagaggagaaatcgaagagaattcgaagaaaggatgttgcggtctggattattagttttagaggttgaatttaaggatatttttttatttagtttcgattttatttatttatatagacgtatagggatttaaagtatccggtcgatttggaaagttagcgatttttgcgagggtgtaaggggcgaggaagagggagcgttttttagggtagttttttcgatattcgagtaagggttggagatagcgtaggggacggtcggtttaggtcgaaagcggtccgatagcggtcttgttttgggaggaattcgatttgtagtgtgttcgtcgcggggattcgtttagctccgggggcgtttcgttatttccggtcgtaggtatttaggtgagtagcgttggttccgggatatcgatttttttttattccgggcgcgaagtttatttgagtaagatttttttatggtgttttcgtggtcgtcgtttttaggaaagtgtggcggcgaggtagcggggcgcgcgtttttagggcgttaattttgggccggtagtaggaaggcgggaagagggggcggtccgtcgtttggagtgtatcgaccgggtctcgttccggtctcgttttcgtttcgtttttttccggagatgcgtatagaattccggtctagccggttgtggtttcgtttttgattcgtttttttttcgtttcgtgaacgtgcgcgtcgagttttattttcgtttatttttgcgttgcgttgtatttggcggagcggggttggcgggcgccgggtctgggagggggcgttttcgcgcggtagcgtagattagattagattaggtcaggccgggggtgggggtcgtttgcgtggtccgtcgcgttcgtagctttgtatttttagcttttcgcgttggcgttaatggttggttccgggagtcgtcgtattttttagtttcgagtccgggcggggcgggtccggtcaggtggaagcgggcggaggtgcgggcgttccgggcggtctcgccgggcgaggcggcggcgccgggtatcgcggcggcgccgggtatagccgggggtcggagccggggtgccggtttagtgggccggggtagggcgggataggatatttgttttgttatttttttggtaattaaaagggtagagtgcgtcgattgagttggagttttagtttttttatttgtaaatgggcgcgttggatagatgattatttgttttttttgcgttgggtatcgtgcgtagctcggtgtatcggtgtagcggggtagatatagggagtcgttttttataattcgggtaacg

SEQ ID NO: 114 - DNA, 2365 bp, Artificial Sequence
  Artificially, CGs methylated, reverse complement ggcC, agCt, Ccgg synthetically methylated, bisulfite treated
gtatgtgtttaaagatgtttagatgaggaggtgttgtgggggaggggggcgggaatagtaagtttttttagctttgtagatttagattttttttttttttgggaagtagggatgtaaagggatagagtttgaaaaagggtttttattattaagctgataaagtaattacgatgtttttagcttatattttgtatagcgttagtggtcattggattataattttttttcgttttttcgtcgttttatattttttttaggtctagttttgaagaatagttattggtattttgtttggcgtttagttaaagttttggttttttaggaggtctcgttttttttatttagatagggttgattttaggtgggtcgtgtgggtagctgggtttaggatatttagatgttagttttggttttggtcatggagcggggaggattttaggttggttattttttagcttggtctgatatttggatagtttgtttattttaatatagttttttttttttccggtctattagagggttttgtttaagttagtttaggagttttttcgaggggcgggggttttaggttccggtagaggtaggtccgttttttagaagttttgttttagagcgttggagattattgtgtgagcttttttttcgtttgttgtatttattttcgcggacgtaggacgtagagttttagtaccggtagttaagaggacgtaggaaagcgtacgtatttataggtttagagacgcggacgttagatttaggtttggatagagtagtttcgtaagttttaatatattttgtaaatttcgaagataggagagagttaaaatattttttttgttcgtacgtaggtcttttttgttttttacggtccgattttgggaggcggatgaggatatttttaggtctggatgggggtcatgggatattttattttagattttgttacgatttgggttgtgttcgttcggtgtttccggtctacgggttgtataatttggcggtctcgaaattggcgtgggggaggggagggttgtttattcgagtaggacgcggttgtttatttagtcggaggtgaggaacgatttttttatttcgttgccgggtttaagcggggtccgagagtcgccggggagagttaaagggaggggatcgatggattttttagagtgaaattgtgcgttttggagagtttcgaggtagtttcgcgagttttcgaggaggtcgttgtcgtttggtaaatataaataataataaaaggaaggaaatttaggcggtagtgcgtagaacgagtatagggttttgtgagggcgcgtagggtttacgcgggtgtttttaatagggttttttacgtaggcggcgcgggtacggggccgggggcgcgcggcgtttttagcgggagggcgtttggattaggggtttcgtttttttttagcgtattttcgtttttttttagcgtattttcgtttcgcgttaggtctattcgtagggttttttttagtacgttcgcggtcgtagtagttagtttagtatttattttcgaagttcgaaatgattttatttagctgcgcgttgatcgcggggttcgatatgatggttggtgggtagcgggtcgcgcggagggtagcggcgaggaagcgtttccggcggggtccgggtcttgcgcgttggttggggcgtcgcgttcgcgtttttgtagtgtagagctagtcgccggaggagtttttaggtcttttggtttagctgaatgaatgggggaggaaggcgggcgccggtcttttttcgcgcgttgcgttttcgtttcgttttcgttttccgggcggattaggttttcgtattcgtaccggtctttttgtttcgtattggttgtttcgttcgtttgttaaggtcaggtctggggggttggggtccgagtggtcgttgggggatagttttgggtatacgaccggagcgtttttttttttttcgtttggtccgcgtttaggggacggcgagagacgcggtcttagtttttttttccgggcgtttcgttgcggtcagatgtgggcggatgtggaggccgggtcatggcgaggagggcgggcgtttagaggggaagagatttttttttttttccgggcgtagggtttttttgtaggaggttgtatttgggtagttaaataaagttttttgttatcgtcgtcgcgcgttttgcgtttgtaagggttaaacggtagcgtacgcggttggtaggtaggattccggtctgtgggtttaagagtcgaggggcgtagggcgaatatgcgagttttatggtattagcgagaggtcattaatttttatttatcgagggtatttttgtagctaatatttttattacgattat

SEQ ID NO: 115 - DNA, 4261 bp, Artificial Sequence
  Artificially, CGs methylated, reverse complement ggcC, agCt, Ccgg synthetically methylated, bisulfite treated
tatttttttttgttttttttttttttttttttttttttttttttagtttgtgaggtttagtaaatatagttaggttgagggttttaggaagttattgattgtgttggaggagctgttttttagttttttgttttgtttttttatcgatttcgaggttgagaatttttaagtttcgttttaggaaatatagtgtttatagtagcttttttagaaattttattggttttggagaaaggaaggtaaattttgtttttcgtttagagtttttttaatttttattgtttttcgttgttattgatggggaggtttacgtatttaggggaggtcaggaaggtcttgagcttgggccgggtattgaggcgttttatatatgttgagagtagggggaacgtatttaggtagttaggggttaggattttatggattagtagtaagtttagtaggttgtagttagcgaaggagatttgtagggtaggggggttagggatttagttagcgggagtaggttggaggaattgggggtagagggtctaagtttattttttaggtttgttttgttttgttaaataaatggtttatatttgtgtttatttggaagtagagggtggcgaggaaggaatagtatggggtcagatgtttatttggttttttataatgaaggttttgtttttttggttttgggatagtagggttttaaaaggttttagttgtccgggtagtgtttttatatagttatttttgttcgttttttgttagatattattatgtattattttatttttattttttttagtttttgagatattttcgtttgttttaggtcagatattagagttttagatttttttttgtttgttttttataattaggttagtattaaattttgtttattttagctgttaatttatttttattttattttgtttgtttatttttgttgggtttttttattagatgattgtaaaagctttagagctggtttttttggaggatttttttagattttatatttagatatagttttgtttagattttttaatggtctttattgtttttaggagattttaaattagtgggtttaaggtcttcgggatttgggtctattgttcgtttatttttatttttttatttattcgatataaatgtaagcgtatatatatatacgtatatatacgtatacgtacgcgtatatacgttgtttttgttgaattggttttaggtttttaaatgtgttttgtgtttgtatattttttttagctaaaagtgttagtatttttatttagaaattggcgataaatttttttttatttttggttattttaggaagttttcgttattttaggagattagaaattattagttgttggaggtttttgtttttgtattcgtttttatgattcgttatttggttggttgatgttttaggtaataagggtgtaggttgtgttttgttttaggtctttgggtctttggtctagagctgatttagtttttgtattttgatttaagaaggggttagtttaagttatttgaggggtaaggggggtgagggtataagaagtttttttttttgtttagtttttagtgtttaattttggtgtagatgtttatatagttggtgtagatgagggagatgtatttgtagcggaggttttttacgtcgttatttattatgtttattagggttgttttttgttggttttttttatagagttttggggttgggtggaggggagtaggtcgcgtgattgggcgtttgattaatatatagttattggggatgggtcaattagggggttgtttgtgagttttagtttgggaggaggggaagaggatgtgcgtggaaggatgagagattgttatatagtaggtgtttagagcttatttgatatttgggaggtagtttggtatagggtaaggattgtaggtatttaggtttgattttgggtaaattacgtaattttagtgggttttagttttttttattttagagggttgcggggtagctgatttaaataaaagggttccgggggtagaggtttgtttatgtttgttttggatttggaggtttaagatttattaagggtgcggtctaggtgacgtaggatggtattggattggtatagggtgaggttttcgttttggaatttggggagctgttcgtatagctgttgggggaggtatggtttagggaggggtattgagcttgggcgtttttcgattttagttatagttttttaaggtctagtattttttttttttgtccgggtatggttatttacgtaggaggttttgagtgagtttttttgttacgtttttacggttattattttttttttttagctttggtcttgatttgttagtagtatgcgtagggtcgcgtagcggtctgcggggagggagaagtacgagatgtggggaccgggtcgatttcgtttcgtagtaatccggggaggggttaggagtgtagggagggaataggtaaataggttttttcgaagattttatataatattggggcggggagtaggtatggcgggagaggcggggaataggaaggaggtccggggtaaaagttatacgacggagggataagggggttcggatttttccgggtgggcgaggggttgtgggttgtagttttagtttttgttttttttttttgttagatatatgtttttatttcgaattgggaaatagattacggtgtagggcggtattgtagcgaataaagaaaagtttgttggagtccgggggaggatgttaaggcgcggtgagcgtagtttgtttttttttttcgtttccggggttttattttttttcgaggcgttccgggtcttttgaaagtcgttaacggtattggggacgttttgggttttttaggtcttcgttccgggtttcgaggtgggcgaggagttttgccgggagtccgggtctgatgttgcgggttggtcttatgttgggagctttgagttttatttccggggagcgggtcgcgcgtatttattggtggcgaagattgcggcggcgaaattttagcgaaggtctcgcggtcttcgagttttataagggtggtttcgtttcgtttcgttttagtgttgagttacggcgccggtcgtttttttggagggtttcgcggattttcgccggtcttagttccggcggtcgttgtattccgggcgtcggtcgtagaggggcgttttggagtttccggagtcgtcgcgtagctggccggggaagttttttttttttttttaggtttttagcggggtctagggagtaaatagatagtaggaagaggatcgtagcgaagtgtgcgtagcgaattggcgcgccgggatatcgcggggggaaattttttaagatcgttgcgattccggagcttgtatattcgttttatagggtaggggagaggggtggaggtcgtttagaggaaaggaaattgttttattttattttattttattttattttattttattttattattttattttattttattttattttattttattttgtgttattttattttattttatgacgtagttttacgttgtggtctaggttggagtgtagtggcgcgatttcggcggtttattgtaattttcgtttttcgggtttaagtaattttgttttagtttttcgagtaggtggaattataggtgcgtgttatatttggttgatttttgtatttttagtagagacggggttttattatgttggccgggttggtttcgaatttttgattttaggtgatttgtacgtttcggttttttaaagtgttgggattataggcgtgagttattacgtttggtcgtttaatttttatttgaagttttggggtatatgtgtaggatgtgtaggtttgttatataggtgtgtgcgttatgatggtttgttgtatagattattttattatttaggtattaagtttagtattttttagctattttttttggtattttttttttttagtatttcgtttaataggtattagtgtgtgttgatcgtcgttatgtgattatgtgtttttattgtttagcttttatttataagtgagattatgcggtttcgttggttttttgtttttgtgtgagtttgttgaggttaacggtttttagctttatttatgtttttgtaaaggatatgattacgttttttttagtggttgtgttttaggttattttttttggttttgttgtttattttttgttgatttgtagatttttatttattttagatattgattttttgtt

SEQ ID NO: 116 - DNA, 6343 bp, Artificial Sequence
  Artificially, CGs methylated, reverse complement ggcC, agCt, Ccgg synthetically methylated, bisulfite treated
tttgtaaaatagaagagaaggaaggttgtaagaagcggcggtcgtcgagtgagtagggtttagatgagattacgttatattagctgttaggcgtttattgtgtgttaggttttaggcgtgttttttcgatttgatagtttttggtatgtgtagtagtatttttagtttagtttcgggtctaggatatttatttattaagaggggatttttttttagagttgtcgtaaaagtgtttagaggttagaggattataaagttatagtgtgttggggaggttgtggatttatttttaagaatttcggtgccggggttaagaatttatttgaacgtaatggtagcgggagtgggtgggtggagaggatttttttttttgggaagctgtatgtaaagattattttttagtgtttgtttattagttggagctcggtaaatatttgtagaatattagcgttaacgtgtttttgttttagatagtagtttttttcggttttttgtaattttgaaacgaacgggtttttggtctagggtgttttaggagcgagctgagttcgggtcttttatttattaggagttatttttttatatttagttatatttttttttagagatattaatccggtcatttatttatttattataaataattattttaaagtatgatttaagatcgtagaggagagatattgggtggattgagcgagattgaggagagtagggtaaacgtttttggagggtttattgttcgttaaggacggagaaatagctttggtataattgttatttagtttttttttttttttttccgggcgagttaaattttttttacgtttttaattataacgtagcgagttaagtatttaacgcgtttttttttttttgttataggtaagccgggagaggtgggtttcgaggggttttaccgggtgggtagaagagtcgcggttgttttaaagataagaaaagaaggtttagggttttttaggtcttttcgattttagcgtttgtttttttttacgttaattagggtacgtcgacgaccggagggtctatttcgcgcgggtgcggggatcggggtgggagtaagcgttgtcgggttggcggaggtatagaggcggggtagggagctgcgggtctgtttttggtctgagtatcgtttttttgcgtttcggtcttttttgaagggagctgggtcttggggagtttttggtcaaggtcgttgtttataggaggggttgtccggcgttgtggcgtggggatttagggtggggacggtcaggcggtttttttattcgttagcgagaacgcgggcggggattttgtcgattcgatttttgtgggtccgtgggtctagaagtagtagtttggcggttttagatttagtgattttgtagtaaaattataggattagtttttgattgagatgtttgttcgtgagatattataaaatttattattatagctttttattaattcgatatgaagtaatatagatgggattttattagtttagattttaaatgtttatttatgataatttcggaggaaatttgtatgttattattatttcgataattttttttttttatatgtttgaattggttgtattattagctggtagccggagtattgtagatggtaattgtaaatagtttttatttatttattttttttaaagaatgaaatatataaaagaaaaagattgcgttgtttggtgtaaagttagttaattattatatatttttttttttattttttcgtgttttagtgttgaagattaaataaagtaatataaaataaatttttaagaatttatagagctttattttaaggattgaaaagaaggttaaggcgtgttttttagcttatttttatatgtttttgtgatttggagatttattttgtagttaaaatgagttttgagatttgtatttttatgttttatttaatgattaggtctattagaagaattgagtttaaataattggggaagataattttttaaaaagagatttttaattttcgtttgttgatttttaaatttgttttattaagataagttttttgtgagaaatttggttgttagatttcggaattggttttaatggttaattttataaattgagatgggagattttttttgatgggaggtagtttttatttttaaagtttatgttttagttggaatgtatatgttaaggatttttgttttggtcaatttgggttttatattgtgagtatataaaaagtattatacggttaacggaggacgaggaattatggtaaagtaggtaggtaagttttaagaaataaaataatttgttaaaaaataatttttgatgattatcgtaagattgaaagtgtaggaaaaatatagttcgaataattttagatttttttatattttttttttttttatatattttgttattttataataaaatttttaatggaaagtttaaaaataaatagtataggaatatgtgttttaaatgaattaaattgtgaaattagttagtaaattaatttgtagtaagtaattatttaaggaaattaaaatattgtttagtttagttttgtattttattatgtgtatgcgttttttataattaattaatataagtgttttaggaatatttgaagataaatacgtttaatttaaggaataaagtatttaaataatttaagtgtaattttgttgagttaaagtaaaatattttataaatgaagtggttatttaattttttagggaaagtttggttattgaaatgttgtatgtttatgttatattaataaaaatttttaatttattttgtttatgtgttttgtttttttgatattattggtatttgaattttagatggatttttgttaaaatgatattttgtgtgataaaagtatttttagttttgattgatagattaaaataaatgtaaggaaatttttttaaattagattaattttttataaaaatattttagaatgtatgaattttgatatttatatttataatggtaaaagtttttttcgtttagtttagtaagataatatttatataaaagagtaaaaaaaaattatattattttatgatagtttgatttttaaattgtttaagaaagtaaagtggttaaattggaaaagaggaatatatttcggaggtttagaatcgaaaattttttttttaatttttagctggaaaataattttttgtatttatttaaagtgtattttttgaagtgttagattggagttgattggtgattaatttaaaggagttataatttaaagaaatggtgagagcttggtatttaggtctggtttttaggtaattcgtttgggtctgagaggttattaattgttagttaagatggaattttttttttttttttttttttttaatggataataatgggaagggggttaattttttagtagctgaaattttgtatttagttttttattttgagaatgttaatttttggtccgaggatttgtttttgtagtgttggtatcgagatttaagggaagatatttcgttttaaatgttagttacggtttggtttttttttcgattttagtattttgtagattgttagtgtttgtggcgggggacgaaaggaatagggttttgtaaggtttgtttgtcgattgcgttattttgggcgaaatttagttttaaaagttataaattatttacggtgaagatttttcgaagtggaataaatttttagattcgtattattttatatttttgcgggatagatggtctttatttaccggttaccgggagagagctgttgttttcgcgttttattgttttccggggcgatttttagcgagtcgagtttccggttgtacggtaagcgttcgaaagccgggtctgagaggattgtagggtttttgagggtgttaagtttcgaaggagtttacgggtgtattggggtcttcgaaatttagtcgttattggtagtttttttttgtttttttttagctttttcgttcggtttcgtattttttttttttttttttttttttattttttttttttttttttgtttttatttcgtgtggggagtgacgtgacgttagtagagattttattaaattttattgtatagtggcgcgcgggcgccggcgagttcgttgcgcggttggcgatttaggagcgagtatagcgtccgggcgagcgccggggggagcgagtaggggcgacgagaaacgaggtaggggagggaagtagatgttagcgggtcgaagagtcgggagccggagccgggagagcgaaaggagaggggatttggcggggtatttaggagttaatcgaggagtaggagtacggatttttattgtggaaaggaggattagaagggaggatgggatggaagagaagaaaaagtaatttgcgttaatccggtagttttaataaattaaagggggagcgttagggtagcggggagatagaaacgtatttttggggagtaaattaggacgggttgggaggaagcgatagggaaagtggtctaagagacggaataaaggataatgtttatggggttgtttgggacgaggcgtgtggagtgtgggtgtgagcgtgcgtgtgtgatttttttttaggtctgtagagttgaggaaagaggttatagtaaagagggattgcggagggaggaaagtgagagaccggtagagggcgggagtggaggtgggcgcggtggggatgggagaggatgagtgaagagaaatttagaagaatggagtgagctagtgggagagggtgggagggtcatagccgggagcgaacgagctaggtttgttagctggggaaggccgggacgttgggtctagcttagctgggatatcgcgttcgaggttaaggcgggtggattaggtatgttgagagtgtcggcgtataggtgggtacggtcacgtattgatttagtgtttacgaagggtttgtattggataaggtttagacgtttatagagtttagaattttttttgttgtatttatatttaataagtttattttgggttacggatattttattttttaaaatgacgaggttaaggtttttggcgaggatggtattaaattgtacgggatagaagtgggggtgggggagagagttttttttaagtttatatttgtttttgtaaagtaaagagtatgtgaaattatagggtatatttttattcgaaaagtgtgttttatttttgaattttgattttttgattttttgatttgagtaaagatgtgtattttggtagtgagtagaatattttggttttgttttgtttttgagtggaaggattataaatataattcgtttggaggattaggtgtgaaggtttttgttaggtatatgggataatgtttttttaattttaagggtattttgttaatgtatgtttttggaaagtgccggaatatagttattgtttttggattcggatttttttattaatattaatttttgtttgagagtaaaatttaggtccgttattaaaaagatatttttttggtttttaattgagaataaagttttttttaaaagttgtattgttttttttaaattaatatattaatattcgtaattttagaaatatatagtgattcgggagaatgtgtataaaatagatacgtttaaaaaagcttggcgtttaaaattaattttagttattatataggtgttgggttttttttatttttgggggttgtttggaatatgttatgtgtttttttgaattatttcgtgttttgaatttatttgagttagtagtaaaaataggtaaataaatttgtttaatttgttttgagtgttaaatttttttattttgaaatagctaatagtcgatagatggatttattttatggaaagggttagtttttttagttacgaagaaaattgattagagatttatattttaagttatttttaatttttacgtaatattcgtgaaaatttaaattttttttttttatttagtggaaatttaaagtagtgttatttaaggggagagaaatgagggggaaaatgtttacgtgttgtttaattgtattttttttttgattttgagaatttttatttttggtttttgaaatttcgtcgaggtaagaaaattaaatttttttaataagttttataattgaattttagttataggataccggaaagtgtagttcgagaaagatatttttatttttgtttatcgacgatttttgtagtttttttatttttttgagtaatgggttaataattttttttttttttttttttattttgtagagattaagaggcgttcgtagtagaacggtcttgtttttagctggtggcgaggataggtaatt

SEQ ID NO: 117 - DNA, 9001 bp, Artificial Sequence
  Artificially, CGs methylated, reverse complement ggcC, agCt, Ccgg synthetically methylated, bisulfite treated
tgtaaagtgattaggagattaggagaatgttgaaatttttgttggaaaaatgtaaagaaaatttttattttgagttagttgtttatagagttagtgtgtgtgtgcgtgtgtgtgtttgtaatataaaatggatgtgaatatatatatataaatagatatggttttgtttttattttaatttgaattatttagataattgtttttatttattatttgattttaatgggtttatataaattaggatattttatttttttaggtatttaggttgttgttgatttttagtgtttttaatatttcgtatacgttggtattatgaggagtagttacgtgtttttgggttttttaattattttggaggttgattgaggttttttatatatgtatatttgtcgtgatgaaagttttatcggtagagtggagttattagagcttttattaaaattttgtgggtttatgagagatgggtttagaaatttatatggttttgtggggtttttcggttttttaaaataaggtattaatatttaagcttttaaaaatatttgtagctttggggtttgaattttgaaaaataaggagtgaggggttgtgtatattaattatagtggagattttttttattttttaatgtgatggagtttttttatgaaatgaagctttaaggggtatggtattgtggggattatagctattttgaggtttaaaagaagaaattggaatatgattagtaaatatatttagtagaaaagagctggatttttattgatttagttataggttatcggttggtagtgtaatgggaggaaatatttattttatatatatattttatgattttgggggaattagaggaaatttaataagaaaacggttagaaatatttaaaatttttatttaaaagatttaagtaaattagagttttattagattaaaaattattataaatgtaagagtattgtttttagtgaaacgttgtggggtttgagaaggagatttttcgttaaatttccgggataaaatgcgttatttaagtattagataatgagtagaatgtaaattaatttaattttttttattaataggttgttagtgtaatgtgtataatttagtgataagattgtaggatttaatatagctggatgtatgagttttagctaatgtagatttgttatatgaggatgtgttttattttgagtaggtgtttgtatgtgtggaatggggtaaagtggaataaaaggttaaaagtagaaatgttgatttaaagcttattatgaagaaattttttttttgtagctaaattatttttaaagtgggatgatattggtgaagaaagattgaaaaataatttttatgtgcgtttttggattgtaagtttaaaatggggaggagttgtagatagggtttgggggtggttagggtaaaggagagatatataagttgtaaatatatttgtagtttgttttatttattttgttttatatcgaataagttttttaattttgtgaataaggataaggagggagtgttttaaagatattttatgttggtattgtaaattattgattgtaatgttaaataaatatatatttagagatgataatattaattttatagtaaaataatcgtttatgtagaaatttagaggagattagtttgttttttttagctgatttatgttgggggataaaaggatttttaaaaattattttgaatatgtttggatttttttttttaatttttttggaaattaaatttgtttggaaatagtgttataaagagttgatgtttttaaaggtgattttttttgttttatataaataaggttttgtttttgttagttgagcgtagttttaggtttttcgtttttagcttatatatattttttttgtttgtttggattttaatggtttaagatagttttgagcttattgggaaaagaaaatgattgttaaaaattatttttgaaattggttatttggtaatatttttaattgtatggaaatttattaaggtatattttatatataattagcttaaggttgttgattttataggttttatggatttaaatttgattgataataaagtaaataagagagtcgaatttaaagcgtggttttttcgggttaggacgagcttaatatagtgtataaggaatttgaaagatttaggatatgtgttttaattaacgttaagtagaatggataagcttttagtattttgaaaacgttgggttagggttttttttttattgtgtgttttttgtttggggattaataagtattatagagaacgtgatttgaggcgattttttatttttgtataaatttagagtgaattattaaatagttgttcgtttaaagttaaggtaatttttttttgacgggtttatttgtttttcgatttttaatttattagtttgtttttttagggttttgttttttttgtaattaaagcttttttagattagcgtagtatttatttgataggttgtttggaaaatttaagatcggagaggtgatttgttgttgttttttaaattttttagttttaagtaacgtgttttttttttatatggggtgggggattggaaatggatgtagtgagatataaagagtgggtgttttgttgatttttgtatttttttttttttgattattttattttttttttttaagttttcgatttttagttttatttttttatttttgggttcgtattaaaagccggatcgttttgggttgggtaggagctgaatttccgggagcttgtttgtgtagatttagtgcgtacggcgaggtagtagtccggtctcgtattgttgataggtgtaggtaggatagtttttttatcgcggttcggggcgttttgattggtgcggagttacgttagtcgtatccggagaagggtttgggaggaggcggaggcggagagggttggggagggtcgcggcggagtgacgtttcggtattaggaagttcgtttttggttttaagatgttaggtcaatagggaagcgcggagtcgtagatttggttcgtcgttcgtttgggtgtttggagctgagctgcggtaaggtccggtttttgttcgatcgttcgaggggtgtgcgtgtgcgcgttgcggagggtgcgtttagagggtcgcgtcgtggttgtagcggttgttgtcgtcgtaggggatttaatattatttatttgtttttgttatttttgatatttttttgttagggttgtcgcgtggggggggggcgggtagagcgcggtcggcgttagctttttttattggaggggtttttgggggagggagggagagaagaagggggtttttgtttatttttgtttcgttttggagcttggaagtttgttttttaaagacgttttgagtggtgtttttttgtttatattttatgttttcgtttgttcgttgatttttcgtttccggattttttcgtttgagttttccggaggagacgggggtagcttggtttgagaattcggcgggggttgcgttttttggtttttttcgtagcggggaaatttcgcgtttagagcgcgatccggagcgggtagcggcggttacgggggttcggcggggtagtagttaaggattagtagagcgtcgcgttttttcgtttatgaattgtatgaaaggtccgttttatttggagtatcgagtagcggggattaagctgtcggtcgtttttttatttttttgttattatttttagtcgttagttatggtttcggttttggtttccggttagttccggtcgttggatttttttaagtataggttggaggtgtatattattttcgatatttttagtccggaggtcgtaggtaaggcgtcgcgtcgttttgtagatattttcgtttagctgttttgcgttattcgttttttttcgttttaaggaagttagtttttccggggggaggcgtggtgggagtggtcgttcgtttggtttttcgtagaatttccgggagccggaattttgattatttcgtatttttttagttttttttcgaccggtccggtttttggggcgttaagggcgcgagtaattttgtcgttttttttattcgtattttggtcttttttttgttttttgggttataaaaattttagtattttgattcgaggatttttagaggtcgtcgatttttgtttttgtttttttttcggtttttagctttcgaggagctttattcgttaggaaattgtttgaaattatttagaaatgtttttcgcgaagaggtattttttttttttttttgggaaagggccggcgaatttcggtgtttaatcgaatttttatatttttttttagtttttttaaatcgtatggaaatttgagctttttgcgagggggaggggggtttgtaaattacgcgcgtgtgcgcgttttaggagatttggtgtgtttgcgtagaggtgtataaatatatttgaaagtataggttataaaagtgaatgtgtcgttgtagtgagataaatatgtaaataaaacgtgcggcgttgggggaggggaggaaatggggcgcggatatttatatttgcgtttgtatattttataggcgtagcgtttttcgcggtccggagtcgtcgcgcgtatttttttccggcgttaggtagtttagcttttttacggtttttgtcgccggtttagttggcgttcgcgttgtaggtgggtatgttgacgggaaagtgtgtgtgtttcgtttttagagaaagataaaagttagtaggggaagaatgaggacgtgggcgtcgaggattcgtttaagaagaagcggtaaaggcggtagcggatttattttattagttagtagctttaggagctggaggtcattttttagaggaatcgttatccggatatgtttatacgcgaagaaatcgttgtgtggattaattttacggaagttcgagtccgggtaggagttagtacggagtttgggagggatggggggaggatgttgtggaggtataggtcaagtagattaggagagaatgtggaaggtagcgtcgtttgggagggcgccggtggggcgtagctttgtaaaggtagaaggtctcgcggcggtctggttgcgagattatagtttttttttcgaggtcgataggattgtcgttttggtttaggtttttagagcggtaccggtttattgtttcgttatttcgcgattttacgagctgggttgtatgggtaattttttgtataggatattgtgtttttggtttgtagttgttagagtagagctaataaaatttttattaggtcaagagtcgcgaataggttttaatttgtgagtttttaataaggaaaattcgttagagatacggaagagttggtcttttttgggaaatttttgttccggtcttggtctagcttttttttttttgggttcgcgttttttatattttttttacggttgtttcggtcatttaggttttttttatatattttattttttagttttgtgatttccgggagtaaagttttaatatataattattagtttttttagaaggagaaagaaaaaaagaagaaagatttttttgtttggtttatttatttttttttaggagttgaattttggaaattgaaatttatatttttttttttaaattataattatagttttgtaaaaagggtttattttaattttgtagtaaatttgtattttatggattggtaaaaatgagcttaaataaataatttaatagtaacgttttggtttatgttggtcggtggaagattttaaatttgttaggattttggaagtagaaaatagaattaagtaaattaagcggtatttagaggttttgttgttaaaaaaaaaaaattaagtgttttgggtagaaaaaataaagtttccggttagagtagagtaaataaaaagaagaaaataacgataaaaagaataaagattaaaatgtttttttaaattagagggaatgaagatattttttgggtggtatttgtgtaaggtatgaggttatgttggtggataaaaggccgggaagaagttgaaaatggttttagtttaattgtttagagttagagctgggttttgggcggcgtggttttgagtaaggttagttttttattagcttttttgtatattaagggaacgggtcttttacgtatttttttcgtttgagtaaagtttagatggtctagggtagaaatggtaagtaattaaagatagagtttatgggttttttgggatttttcgaaaacgtttttttatttcgttcgttatttcgtagctttattttagtgttttgtagtcgcggcgttgggttttttttgtagctgtttttttttttagggcggttgtttgtcgagttaagtgggagtgaggcgtgttttttatagtagtcgggtgtaaagaggaagggggataaaaaggaaattaagaatgaaaggaaaaagagaaaaagcggattatacggttgggtccggcggagatgtgtaatgtgaaatattattggtgttagctcggatattttaggtcaggtctttttttaatatataaaagtcgtcgtttggggcgatagggaggtccgatgtggattgggatcggggttgcggttgggtcaccggatacgggtggaagccggccggtctgggtggtcgtttgtaaagttaaacgatccggttgggtctggcgcgcggataggtctgtggtgggtttagggtaaagaagaggtagagcgaaagaagggggaatttttaaaattattttttccgggtttccggagtttaatatgttaagcttttggagttaacgagctgacgaagaggtggttttttgttttttatttggttgttttgttaggcgagaaagagtgttggcggtctagtttttgttaagggagtacgtattagggggtgggggacgatagtggaggttagggaaggaagggaggaattgcgtgggagaaagagcgattttttagtgtttttttagttttttttttttattcgtgggtttgtggttttggaatggaagtaagtttgtaaggtgttccgggaagggttggaaaagtttgttgtttcgcgtttgttttatattaagtgtttttggatttggagaaacgtttggttgagtgattaaatcgttcgtaggtttttatgcgttcggttgaggtttgtggcgtagcttcgagttttagctcgtaggtcagagtagattaggttttttgcgtttggtggagatccgggtcagtaattgaaagctggtcttggtattttggtgtgtagggcggtgtagtgaagcgaggtcagggtgtgtgagtgcgttagcgtgtgtgtcgggggaaggcgggggttggtcttcgatggaagttttagtaatttgtattgtggtatttgtttgtttttttgttttaatcgtttttaggtttggtttaagaatcgtcgggtcaaatggagaaagagggagcgtaattagtaggtcgagctatgtaagaatggtttcgggtcgtagtttaatgggtttatgtagttttacgacgatatgtatttaggttatttttataataattgggtcgttaagggtcttatattcgtttttttatttattaagagcttttttttttttaattttatgaacgttaattttttgttattatagagtatgttttttttatttaattttatttcgtttatgagtatgtcgtttagtatggtgtttttagtagtgataggcgttccgggttttagttttaatagtttgaataatttgaataatttgagtagttcgtcgttgaatttcgcggtgtcgacgtttgtttgtttttacgcgtcgtcgattttttcgtatgtttatagggatacgtgtaattcgagtttggtcagtttgagattgaaagtaaagtagtattttagcttcggttacgttagcgtgtagaatccggtctttaatttgagtgtttgttagtatgtagtggaccggtccgtgtgagtcgtatttatagcgccgggattttaggattttgccggatggggtaatttcgtttttgaaagattgggaattatgttagaaggtcgtgggtattaaagaaagggagagaaagagaagctatatagagaaaaggaaattattgaattaaagagagagcttttttgattttaaagggatgtttttagtgtttgatattttttattataagtatttttaatagttgtaaggatatatatataaataaatgtttgattggatatgatattttaatattattataagcttgttattttttaagtttagtattgttaatatttaaatgattgaaaggatgtatatatatcgaaatgttaaattaattttataaaagtagttgttagtaatattataatagtgtttttaaaggttaggttttaaaataaagtatgttatatagaagcgattaggatttttcgtttgcgagtaagggagtgtatatattaaatgttatattgtatgtttttaatatattattattattataaaaaatgtgtgaatattagttttagaatagtttttttggtggatgtaatgatgtttttgaaattgttatgtataatttattttgtgtataatatttcgtataatattattgttttattttttagtaaatatgaaataaatgtgttttattttatgggagtaaaatatattgtatataaattggtttggattttttttttttttttttgttattaatttggtcaggatattttagttattgttttttaaataaattagttttttttgtttgtttagttaaatatataaggtagtagtttttatttaaatttggtagaaataaatgatagttatttattagaaattaaaaagaaaaaaaaaggtatttccgggggggaaaagggttataaaatttaattttgtttttttaatttttttttggtttaaatttagaggattttattatggttagtaaataatatgaaaaagaaaaaagaagaaagaaatttagtaagtttattagct

SEQ ID NO: 118 - DNA, 1920 bp, Artificial Sequence
  Artificially, CGs methylated, reverse complement ggcC, agCt, Ccgg synthetically methylated, bisulfite treated
tgtagggttggggataggtacgtgagggggagaattttgagtagatagggaatttgtagccgggttgtttaagggtctttgtgtattgggggcgttaggaggtttagggatggaaaagggggaggtgagaaatggataaagaaatttggtctttttggtattgttgttacgtttggccggtccgttaagtcgaaggggtctgtttagtttttgtccggtttaaatttttttgggaataagctgggatgttagaaaaaataaaattttataatttttgtttggggaatttaggtcgttggaggtgggtttggtagggtagcgtgattgttttttgggagtggttgttatagctccgggtgaatcgaggagcttgggtcaagtttttattttttttggagagggtagtagtaaggaggtgaggggagttagcttattttttttaattttgtattttttttttatttttttatttttagtccggaagaatcgttggcggcgggagtttggacgagctggcggggaaggggacgtagttatagtattgtttgggagggaggggagaagcttcgtttttagaggggaggggagaagaggagggggtaggagataaggggaggaagaaaggcgaaggtaaggcgaaggggtggagagtgatatgaagagcgagagaaaagagaggatagcggacgagtagatccggtaggggttgaaaaaggtcaaggggttggagggagggagaggaaggaggaggggagcgaggagggcggggcgtccggtttttagtcgcgcggtcatcgtttgtttagtttggttggatttgagtccggtccgtcgatcgttggtcgaggcgtagctgaagtagttttttagtcgcggcgtttttattttttaattttacggtttttgcggcgcgggcgcgatgtagctggtccggggtgaaggtaaggcgcggggcgcggggcgcggggtattgggagcgaggtattggcgcgggatgtccggcgtaaggtgtagggcgcgggtcgtttttttttcgcgtttttttatttcgttaaagtttttttacgatggtttttattccggttgggttagtttcgtaattttcgtttgttttttgttttttttttttttttcgagtcgcggggtttccggggcgcgcggattttcgttaggggtcgtgtaggcgcggagttttagccggtctgttttgggttcgaagaaagttgtggtttggagctagttttttttttacgatttttgggggcgtttttttttttttttgagttcgcgatgggaaggcgtttttattttatttccggggtttttgagattttttggcgaggtggggcggcgcggtaggtgtagggttggggagggtctgatagttttggagagtgttcgattttagttcgtcgtcgttttttaggcggattttttagaggtaggttttagtttccggcgcggggaggcggcgcgttttagaggggcgtagggtgcgcgggggtcgttggtcttccgggtattttttttttgcggttttttcgttttttttcggagctggtgtttgaggtcgttgggattttagtttggcgttttttttcgtttcgagcgaggtaggtgtcgtgggcggtcccggttatttttgtatttcgagcgtttattttgtatttagctttaagtcggagagctttggggatagtcgagagtgttagtggtcttatagggagattgagggttttgttttatttcgggcgtcgtgtgggtttgggttgtttatagtatttttgcgttttagtgataggagaagttaagcgcgaggtcttttaatagctgcgtgtattttattttttaggtatttggaattccggcgtttagaacgtgtttttcgggagagtaaaggttgtgtttacggtagtttgg

SEQ ID NO: 119 - DNA, 5473 bp, Artificial Sequence
  Artificially, CGs methylated, reverse complement ggcC, agCt, Ccgg synthetically methylated, bisulfite treated
ttttattttttgttttattgatgtgttattattgggggggttggagtagtaaaaaaagaagaaggaaaaaaagagcggggttttgttggtagaggttgagcgccgggttgacgtgcggcggcgatggaagaatttacggcgttcgtttttaagttttttgattagaaagtgaaggagaagaaggaggcgattacgtaccgggaggtgttggagagcgggtcgttgcgcggggtcaaggagtcgaccggttgtatcgaggcgggtcgcgacgatcgtagtagtccggtagtccgggcggccggcggaggcggcggcggaggaggcggaggcggcggcggaggaggcggaggaggtgtaggaggaggaggagtaggcggaggagctggaggagggcgttttttcgtccgggagctggatatgggcgtcgtcgagagaagtagggagccgggtagttcgcgattgacggagggtaacgatttgattgatttccggtagcggttttttttttcgttttccggatttttttcgggcgggagaggatttcgaggtctagcggggaggggagagggatacggagagggtcttggattttagctttgttagctagagtgatagtggaagggtgggggtccggtggtatgttcggttatgggtggggttttagtgtgttgtgggggtggcgtggggggaagcgtgtggggtttgtgcgcgttttttttagatgtttttattttatcgaaatgtattttttattagcgggaggatgggtccgtagtccggatggtccgtaggcggacgtggaagttcgcggggccgggttgtaggagggggtgttgaattagacggcgggattaaagctagtttttagcgtagagtttgccgggagggagaaggggtagaggtggaaagcttaattttccggtcgtttaggtgtttggggtcgttaagatttttcgaatttcgtagagtttttgaatttttggattttaggggtcaaaattttttatttttttttaaggtagaaggaagttaacgaaagctgaggtttaggttacgttgttttttccgggcgaggcgtttcggttttttggtgtgttgggggcggggggggggggcggcgggggaggtggggatttatatttatataatttttttagtgtttttaattatttagtattcggtttttttagagtaaaaattttttggtgttagcttagtgttaggaaacgtttttattttaatggtagagcgttttatattaatttaaaggagtttaataataaaattgatttggtatttggtgtttgtagtaattggtgtattgttatatttttttaattaagaaaatatgtggtatgcgtggaattatatatttaagtaagtaattaagttgtttatgatacggtttgtttttgtttagattagtaattggaaatttggggataaaaatagagattttattaagtttatggattaatttgaaatttggatattttttcgaagttttaaaattttgagtggtatttattgtgtagatgatatgtaatagataaagtttttttattttattggtagaatttgaagggtgtgtttttatatttaaattttaatataatattagtaaaaatattttgttattaaattggtctataatgtttattataatgtttttttttaaagaaaggataaatgtttataaaattaattttgagaattagaaaatacggtaatatttaagattatcgtagctagaatgtccggtagggtcgagatttagcgatttttttttttttaaattagtattaggtttttttaaatttgtaaagtggtggagttatcgttaaggtgtttagtgtagttttccggtcatgagtttataattataggtccgaattataggttcgttagcgcgtttgacggcgaggtttaggtttgaatttccggcgggcgtagtttttgggattgttgatttttaagcttagggtaagtattaatttttttgtagaccggtttttccggaaatgatttttaatatttatgttggtctggattttgcgttgggaagaattgtaaatagtttcgattatttaaatttagctttgattttttaaaatccggagtttttgattcgggcgtagaggataaaggttttagggggatatatatatggtggttgtatatgtttatattagaagagcttttgtttttaaagggaggagaaggataggaaagtggtaacggatgtgtgtaaatttagagtagaaaaatttatattttattaaatattcgagctgttggttgtatgaaaaggttttgagtaattaatagaaatcgaggatcgcgaatatttcgtttgaatttgttgatttttgtgggttaagcgtttagggtcgagtttgcgtttttacgagggagggcgaagagagaatagaaagagcggttgttttcgttcgttaccggaggttggtttttcgttttttgttttttggtccggtttgggcggcgagttttttgggtagttaatatggcgtgggcgtttgtgttcgtgcgattccggtcgggtaggcgggacggagattatttggttgtttaggggattttatgtagggtttggtccgagtttaggggtagcgaggggcgtttgcggatgcggttttttgtgcggtataataccggggtttgttgttttcgttgatatttttcggtctaattgtttttaaattagattagtaagtttgcggtaggtagagagttagcggtggtgagagctggtctgagaacgagttagttttttgggaatggccggtgtgagaggtcagtgggtggtcttgtcgcgtttttatgtttagattttgttttgtgagaggtctggcgttgcgtttttgatttttgtgagtgttgcggagtaagtgagtgcgaaagtgagtggaaattatttggtgtttgttggggaaggccggtgattggggggtgaatagtgaggcggtgagtcgaggtacgtttgtgaaggaggtggtggatgattgtttattttgttttaggcggtcgtttagatttgatttttgcgtttttccgggatattttttttccgggtgggttgagaagccggattaggattttacgagggggaaggattttttatttttttttgcgataaatttggtaataggatttgttgtgttgttttcgttcgtgtgtgtgtgcgtgtgtgtgtgtgttcgtgtggatgtacgtgtggtctcgttggggtgttttttttagtgtttccggagctgaaagatcgtaaagaggatgcgaaagggatggaggacgaaggtcagattaaaattaagtagaggcgaagtcggattaattttattttggaataatttaatgagctggagaggttttttgacgagatttattatttcgacgtttttatgcgagaggaattgagttagcgattgggtctgtcggaggtccgagtgtaggtatttagctgttaggaggtcgagggtctagggagtagagagagtttggggttggaaagaggtttgggggatatattcgggaggtggtgtttttagtgtttggtgtaagatgagaaggaaagagatatttttattagaggttttattttttaaagtagattttagttttatagtatttttttttttttttttttttttattttaatatatgtttttagaagaagaaagctgtgttgggtttttttttagagtttttataaattatattttttttgtttcgtattggttttaatgtggtttaattttaatgggtctatttttataaggtttaaaaaaaaattttatagaaaacgttttatttttggatgttttaaaagttttaaagagtattttgttttttggagttggatttttttgaaagtttgttttgtagggtttaggtttgttaagcggatattttaattaggtttatagatgtgtagattataaagaaaattagtaattgttaagtgtagaaatttatagtttgttgttagcggtcgattttaaattgtgtgtgaaatagcggagaaataaacgtattttggttattttttgtttatttatttaattaaggtaacgaaattgattttaaatatattagattttaaaataaattatatatattagtatttatatttttaaagtttgttttttagtacgtgttatatttaatgaagttaggattgaaatagattttttttattggttgtggaggtaaatgtaatagtaaaaataggttttgggggtatttaaaggagtaaattgtgtatatttatatatatatatttttttagctttagggggaataaatttaaatgttttagattgtattttcgtttagataataaaatagaataaaatgatagttattattggtttgaatatatggagtagttttaggtccgtatatttgtagctgttataaagtatcgttgtaatagatattttttcggtttttgggtatagagattattatttgtagcgaattatgtataatttttaaggggtttttttatattttgtaataggattaggaaaaaaaaaaatagagtagttacgttgaagaggaaaagtaataataggttgttttggttattatagtattagtagtagagtttttttttttaagttttttttgtttcgttttgtgtattgagatttttagaggtttagtaattttttaaaaatatgatgataattattatagttatgattattagtattttaattttaatttttttaggggaaaaaaaggtaagaagttttaggtcatgtgaattatataaaggatgttattttggtataaaatttattttttgttgtattaaatagtagagaaatttttgaagatttatattgattatgatatttgtttttaaaaatatattaatgaaagctttgaagtagtatttttattttaatggggttttaaaaattttaatttgtgagttaattaatatgttttattattgaaagtggaatataaaagtaagctttatttgaattttaaaaaatttgttatattgtttgtaaaagttgttaagtttaagtaggtaatatttaggagaataaagtatttaagagttatttgttttatatatattttatttttttttcgttgagtgttttttttttttttttttaagaagtgaattttattgttgttttatatttttatttatattttagttattttttagatgtttttttattattttaattgtaaatagtggttttttttaaagaagtaaattagattattatgataatggtgtataattattttgttattgtgttttattttgttgtatagtagaatagagaaattttaaatttttttgtagtgaggtttttatgatattaattatttttttttaatttttataatttttttttcgtaaaggagttattatttgttttggtgtttggtttttttttaagatgaagctaattaatattat

SEQ ID NO: 120 - protein, 4 aa, Arthrobacter luteus
AGCT

SEQ ID NO: 121 - protein, 4 aa, Arthrobacter luteus
TCGA

SEQ ID NO: 122 - protein, 4 aa, Haemophilus aegyptius
GGCC

SEQ ID NO: 123 - protein, 4 aa, Haemophilus aegyptius
CCGG

SEQ ID NO: 124 - protein, 4 aa, Moraxella bovis
CCGG

SEQ ID NO: 125 - protein, 4 aa, Moraxella bovis
GGCC

SEQ ID NO: 126 - DNA, 21 bp, Artificial Sequence
  Artificial primer desinged for Septin9 HM assay
gttgtttattagttattatgt

SEQ ID NO: 127 - DNA, 19 bp, Artificial Sequence
  Artificial primer desinged for Septin9 HM assay
aaataatcccatccaacta

SEQ ID NO: 128 - DNA, 33 bp, Artificial Sequence
  Artificial Blocker designed for Septin9 HM assay uncoserved
gttattatgttggattttgtggttaatgtgtag

SEQ ID NO: 129 - DNA, 18 bp, Artificial Sequence
  Artificial probe for Septin9 HM assay unconserved
cgttaaccgcgaaatccg

SEQ ID NO: 130 - DNA, 21 bp, Artificial Sequence
  Artificial primer for conserved Septin9 HM assay
gctgttcatcagtcatcatgt

SEQ ID NO: 131 - DNA, 19 bp, Artificial Sequence
  Artificial primer for conserved Septin9 HM assay
aaatgatcccatccagctg

SEQ ID NO: 132 - DNA, 33 bp, Artificial Sequence
  Artificial Blocker for conserved Septin9 HM assay
gtcatcatgttggattttgtggtcaatgtgcag

SEQ ID NO: 133 - DNA, 18 bp, Artificial Sequence
  Artificial probe for conserved Septin9 HM assay
cgttgaccgcgaaatccg

SEQ ID NO: 134 - DNA, 66 bp, Artificial Sequence
  bisulfited treated segment of Septin 9 sequence
ttcgttgtttattagttattatgtcggatttcgcggttaacgcgtagttggatgggattatttcgg

SEQ ID NO: 135 - DNA, 64 bp, Artificial Sequence
  Preserved and bisulfite treated segment of Septin9
ttcgctgttcatcagtcatcatgtcggatttcgcggtcaacgcgcagctggatgggatcatttc

SEQ ID NO: 136 - DNA, 19 bp, Artificial Sequence
  Reverse primer sequence desinged for Septin9 HM assay
atcaacctaccctaataaa

SEQ ID NO: 137 - DNA, 19 bp, Artificial Sequence
  Reverse primer sequence for conserved Septin9 HM assay
gtcgacctaccctagtaaa

What is claimed is:

1. A method for preserving genomic DNA complexity during methylation analysis of genomic DNA of a subject, comprising:
    a) isolating genomic DNA, or a fragment thereof, from a biological sample obtained from the subject;
    b) contacting the isolated genomic DNA or fragment thereof with at least one enzyme that adds a methyl group to a cytosine nucleotide outside of CpG dinucleotide sequences of the genomic DNA and does not add a methyl group to a cytosine nucleotide within the CpG dinucleotide sequences of the genomic DNA, wherein the at least one enzyme has a recognition sequence that consists of a CpT or CpA dinucleotide and methylates the cytosine of the CpT or CpA dinucleotide it recognizes;
    c) treating the enzyme-treated genomic DNA, or fragment thereof, of step b) with at least one reagent to convert unmethylated cytosine bases to uracil or to another base that is detectably dissimilar to cytosine in terms of hybridization properties, thereby preserving the DNA complexity; and
    d) detecting DNA methylation of the preserved and treated genomic DNA, or fragment thereof, of step c), on a genome wide scale.

2. The method of claim 1, wherein step d) comprises:
    a) amplifying the preserved and treated genomic DNA by means of an amplification enzyme and at least one oligonucleotide, wherein the oligonucleotide is identical, is complementary, or hybridizes under stringent or highly stringent conditions to an at least 9 base long segment of preserved and treated genomic DNA to produce an amplificate; and
    b) detecting the methylation state or level of at least one CpG dinucleotide of the genomic DNA, or an average, or a value reflecting an average methylation state or level of a plurality of CpG dinucleotides of the genomic DNA based on a presence, absence or amount of, or on a property of the amplificate.

3. The method of claim 2, wherein the reagent is a solution of a bisulfite, hydrogen sulfite or disulfite or a combination thereof.

4. The method of claim 1, wherein the at least one enzyme is DNMT2.

5. The method of claim 1, wherein the genomic DNA comprises at least one target region comprising at least 16 contiguous nucleotides of SEQ ID NO:1.

6. A method for preserving genomic DNA complexity during methylation analysis of genomic DNA of a subject, wherein the genomic DNA comprises at least one target region, the target region comprising at least 16 contiguous nucleotides selected from the group consisting of SEQ ID Nos.: 1 to 7, wherein the contiguous nucleotides comprise at least one CpG dinucleotide sequence, comprising:
    a) isolating the genomic DNA, or a fragment thereof, from a biological sample obtained from the subject;
    b) contacting the isolated genomic DNA or fragment thereof with at least one enzyme that adds a methyl group to a cytosine nucleotide outside of CpG dinucleotide sequences of the genomic DNA and does not add a methyl group to a cytosine nucleotide within the CpG dinucleotide sequences of the genomic DNA, wherein the at least one enzyme has a recognition sequence that consists of a CpT or CpA dinucleotide and methylates the cytosine of the CpT or CpA dinucleotide it recognizes; and
    c) treating the enzyme-treated genomic DNA, or fragment thereof, of step b) with at least one reagent to convert unmethylated cytosine in terms of hybridization properties, thereby preserving the DNA complexity.

7. The method of claim 6, further comprising:
    d) contacting the preserved and treated genomic DNA, or fragment thereof, with an amplification enzyme and at least one oligonucleotide, which is identical, is complementary, or hybridizes under stringent or highly stringent conditions to an at least 9 base long segment of a sequence selected from SEQ ID NOs: 36 to 63 and SEQ ID NOs: 92 to 119, wherein the treated genomic DNA or the fragment thereof is either amplified to produce at least one amplificate, or is not amplified; and
    e) detecting, based on a presence, absence or amount of, or on a property of the amplificate, the methylation state or level of at least one CpG dinucleotide of SEQ ID NOs: 4 to 7, or an average, or a value reflecting an average methylation state or level of a plurality of CpG dinucleotides of SEQ ID NOs.: 1 to 7.

8. The method of claim 7, further comprising use of at least one nucleic acid molecule or peptide nucleic acid molecule comprising in each case a contiguous sequence at least 9 nucleotides in length that is complementary to a sequence selected from the group consisting of SEQ ID NOs: 36 to 63 and SEQ ID NOs: 92 to 119, and complements thereof, wherein the nucleic acid molecule or peptide nucleic acid molecule suppresses amplification of the nucleic acid to which it is hybridized.

9. The method of claim 6, wherein the at least one enzyme is DNMT2.

10. A method for detecting CpG methylation in genomic tumor cell DNA, comprising:
   a) isolating genomic tumor cell DNA, or a fragment thereof, from a biological sample obtained from the subject;
   b) contacting the isolated genomic tumor cell DNA or fragment thereof with at least one enzyme that adds a methyl group to a cytosine nucleotide outside of CpG dinucleotide sequences of the genomic tumor cell DNA and does not add a methyl group to a cytosine nucleotide within the CpG dinucleotide sequences of the genomic tumor cell DNA, wherein the at least one enzyme has a recognition sequence that consists of a CpT or CpA dinucleotide and methylates the cytosine of the CpT or CpA dinucleotide it recognizes;
   c) treating the enzyme-treated genomic tumor cell DNA, or a fragment thereof, of step b) with at least one reagent to convert unmethylated cytosine bases to uracil or to another base that is detectably dissimilar to cytosine in terms of hybridization properties, thereby preserving the DNA complexity; and
   d) detecting the methylation state or level of at least one CpG dinucleotide of the genomic tumor cell DNA, based on a presence, absence or amount of, or on a property of the amplificate.

11. The method of claim 10, wherein the subject has a proliferative disorder selected from the group consisting of: a hepatocellular proliferative disorder, a colorectal proliferative disorder, a lung proliferative disorder, a breast proliferative disorder, and a prostate cell proliferative disorder.

12. The method of claim 10, wherein the at least one enzyme is DNMT2.

* * * * *